United States Patent
Sorek et al.

(10) Patent No.: US 10,767,156 B2
(45) Date of Patent: Sep. 8, 2020

(54) POLYNUCLEOTIDES ENCODING BREX SYSTEM POLYPEPTIDES AND METHODS OF USING SAME

(71) Applicant: Yeda Research and Development Co. Ltd., Rehovot (IL)

(72) Inventors: Rotem Sorek, Rohovot (IL); Hila Sberro, Rehovot (IL); Tamara Goldfarb, Rehovot (IL)

(73) Assignee: YEDA RESEARCH AND DEVELOPMENT CO., LTD., Rehovot (IL)

( * ) Notice: Subject to any disclaimer, the term of this patent is extended or adjusted under 35 U.S.C. 154(b) by 0 days.

(21) Appl. No.: 15/030,876

(22) PCT Filed: Oct. 14, 2014

(86) PCT No.: PCT/IL2014/050902
§ 371 (c)(1),
(2) Date: Apr. 21, 2016

(87) PCT Pub. No.: WO2015/059690
PCT Pub. Date: Apr. 30, 2015

(65) Prior Publication Data
US 2016/0281053 A1    Sep. 29, 2016

Related U.S. Application Data

(60) Provisional application No. 61/894,993, filed on Oct. 24, 2013.

(51) Int. Cl.
| | |
|---|---|
| *C12N 1/21* | (2006.01) |
| *C12N 9/10* | (2006.01) |
| *C12N 9/02* | (2006.01) |
| *C12N 9/16* | (2006.01) |
| *C12N 9/48* | (2006.01) |
| *C12N 9/52* | (2006.01) |
| *C07K 14/245* | (2006.01) |
| *C07K 14/32* | (2006.01) |
| *C07K 14/195* | (2006.01) |
| *C12N 1/20* | (2006.01) |
| *A23C 9/123* | (2006.01) |
| *C12N 9/12* | (2006.01) |
| *C12N 9/14* | (2006.01) |
| *C12N 15/52* | (2006.01) |

(52) U.S. Cl.
CPC .............. *C12N 1/20* (2013.01); *A23C 9/1234* (2013.01); *C07K 14/195* (2013.01); *C07K 14/245* (2013.01); *C07K 14/32* (2013.01); *C12N 9/0051* (2013.01); *C12N 9/1007* (2013.01); *C12N 9/12* (2013.01); *C12N 9/14* (2013.01); *C12N 9/16* (2013.01); *C12N 9/48* (2013.01); *C12N 15/52* (2013.01); *C12Y 108/04008* (2013.01); *C12Y 201/01072* (2013.01); *C12Y 207/11001* (2013.01); *C12Y 301/03001* (2013.01); *C12Y 304/00* (2013.01); *C12Y 306/04012* (2013.01); *C12Y 306/04013* (2013.01); *A23C 2220/202* (2013.01)

(58) Field of Classification Search
None
See application file for complete search history.

(56) References Cited

U.S. PATENT DOCUMENTS

| | | | |
|---|---|---|---|
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |

(Continued)

FOREIGN PATENT DOCUMENTS

| | | |
|---|---|---|
| EP | 0121775 A1 | 10/1984 |
| EP | 0036776 A2 | 5/1988 |

(Continued)

OTHER PUBLICATIONS

GenBank, Accession No. NZ_ABDL0200007.1, 2010, www.ncbi.nlm.gov.*
Morita et al. ("Complete genome sequence of the probiotic Lactobacillus rhamnosus ATCC 53103," J. Bacteriol., 2009, 191, 7630-31.*
Mierau et al., 10 years of the nisin-controlled gene expression system (NICE) in Lactococcus lactis, Appl. Microbiol. Biotechnol., 2005, 68, 705-17.*
GenBank, Accession No. NC_009800, 2013, www.ncbi.nlm.nih.gov.*

(Continued)

*Primary Examiner* — Robert B Mondesi
*Assistant Examiner* — Todd M Epstein
(74) *Attorney, Agent, or Firm* — Mark S. Cohen; Pearl Cohen; Zedek Latzer Baratz LLP

(57) ABSTRACT

Isolated polynucleotides encoding a BREX system are provided. Accordingly there is provided an isolated polynucleotide encoding a BREX system comprising a nucleic acid sequence encoding the BREX system comprising brxC/pglY, pglZ and at least one of pglX, pglXI, brxP, brxHI, brxHII, brxL, brxD, brxA, brxB, brxF, and brxE, with the proviso that said BREX system does not comprise pglW, and wherein said BREX system confers phage resistance to a bacteria recombinantly expressing same; Also provided is an isolated polynucleotide encoding a BREX system comprising a nucleic acid sequence encoding the BREX system comprising brxC/pglY, pglZ, pglX, pglW and at least one of brxD and brxHI, and wherein said BREX system confers phage resistance to a bacteria recombinantly expressing same. Also provided are compositions and methods for conferring phage resistance to bacteria or for conferring bacterial susceptibility to phages.

9 Claims, 17 Drawing Sheets
(16 of 17 Drawing Sheet(s) Filed in Color)
Specification includes a Sequence Listing.

(56) References Cited

U.S. PATENT DOCUMENTS

| | | | |
|---|---|---|---|
| 3,901,654 A | 8/1975 | Gross | |
| 3,935,074 A | 1/1976 | Rubinstein et al. | |
| 3,984,533 A | 10/1976 | Uzgiris | |
| 3,996,345 A | 12/1976 | Ullman et al. | |
| 4,034,074 A | 7/1977 | Miles | |
| 4,098,876 A | 7/1978 | Piasio et al. | |
| 4,551,433 A | 11/1985 | Deboer | |
| 4,666,828 A | 5/1987 | Gusella | |
| 4,683,202 A | 7/1987 | Mullis | |
| 4,689,406 A | 8/1987 | Banks et al. | |
| 4,738,921 A | 4/1988 | Belagaje et al. | |
| 4,801,531 A | 1/1989 | Frossard | |
| 4,879,219 A | 11/1989 | Wands et al. | |
| 5,011,771 A | 4/1991 | Bellet et al. | |
| 5,028,530 A | 7/1991 | Lai et al. | |
| 5,192,659 A | 3/1993 | Simons | |
| 5,272,057 A | 12/1993 | Smulson et al. | |
| 5,281,521 A | 1/1994 | Trojanowski et al. | |
| 5,464,764 A | 11/1995 | Capecchi et al. | |
| 5,487,992 A | 1/1996 | Capecchi et al. | |
| 6,242,194 B1 | 6/2001 | Kullen et al. | |
| 6,774,279 B2 | 8/2004 | Dymecki | |
| 8,586,526 B2 | 11/2013 | Gregory et al. | |
| 8,771,945 B1 | 7/2014 | Zhang | |
| 2003/0232410 A1 | 12/2003 | Liljedahl et al. | |
| 2004/0053289 A1 | 3/2004 | Christian et al. | |
| 2005/0025157 A1 | 2/2005 | Baltimore et al. | |
| 2006/0014264 A1 | 1/2006 | Sauer et al. | |
| 2014/0283166 A1 | 9/2014 | Chomet et al. | |
| 2016/0281053 A1 | 9/2016 | Sorek et al. | |

FOREIGN PATENT DOCUMENTS

| | | |
|---|---|---|
| EP | 0267851 B1 | 1/1994 |
| WO | WO 2004/020598 A2 | 3/2004 |
| WO | WO 2009/071334 | 6/2009 |
| WO | WO 2010/075424 A2 | 7/2010 |
| WO | WO 2011/146121 | 11/2011 |
| WO | WO 2014/085593 A1 | 6/2014 |
| WO | WO 2014/104878 A1 | 7/2014 |
| WO | WO 2015/059690 | 4/2015 |
| WO | WO 2015/059690 A1 | 4/2015 |
| WO | WO 2018/142416 A1 | 8/2018 |

OTHER PUBLICATIONS

Sumby et al., Genetics of the phage growth limitation (Pgl) system of Streptomyces coelicolor A3(2), Mol. Microbiol., 2002, 44, 489-500 and Supp. Table S14.*

Guo et al., Protein tolerance to random amino acid change, Proc. Natl. Acad. Sci. USA, 2004, 101, 9205-10.*

Genbank, Accession No. NC_011891, 2013, www.ncbi.nlm.nih.gov.*

Markarova et al., Defense islands in bacterial and archael genomes and prediction of novel defense systems, J. Bacteriol., 2011, 193, 6039-56 and Supp. Table S14.*

Uniprot, Accession No. Q8CJM2, 2013, www.uniprot.org.*

Genbank, Accession No. WP_011031053, 2017, www.ncbi.nlm.gov.*

Gordeeva et al., BREX system of *Escherichia coli* distinguishes self from non-self by methylation of a specific DNA site, Nucleic Acids Res., 2019, 47, 253-65.*

Moineau et al., Expression of a Lactococcus lactis Phage Resistance Mechanism by *Streptococcus thermophilus*, Appl. Environ. Microbiology, 1995, 61, 2461-66.*

International Preliminary Report on Patentability dated May 6, 2016 From the International Bureau of WIPO Re. Application No. PCT/IL2014/050902.

International Search Report and the Written Opinion dated Mar. 4, 2015 From the International Searching Authority Re. Application No. PCT/IL2014/050902.

Bedford et al. "Two Genes Involved in the Phase-Variable Phi C31 Resistance Mechanism of Streptomyces Coelicolor A3(2)", Journal of Bacteriology, XP055168261, 177(16): 4681-4689, Aug. 1995.

Chinenova et al. "[Genetic Characteristics of a New Phage Resistance Trait in Streptomyces Coelicolor A3(2)]", Genetika, 18(12): 1945-1952, Dec. 1982. Abstract.

Goldfarb et al. "BREX Is a Novel Phage Resistance System Widespread in Microbial Genomes", The EMBO Journal, XP055168267, 34(2): 169-183, Published Online Dec. 1, 2014.

Kroeger et al. "*Salmonella enterica* Subsp. Enterica Serovar Typhimurium SL1344 Complete Genome", Database EMBL [Online], Retrieved From EBI Accession No. GenBank: EM_STD:FQ312003, Database Accession No. FQ312003, Feb. 27, 2015.

Kroeger et al. "The Transcriptional Landscape and Small RNAs of *Salmonella enterica* Serovar Typhimurium", Proc. Natl. Acad. Sci. USA, PNAS, XP055168173, 109(20): E1277-E1286, Published Online Apr. 25, 2012.

Laity et al. "Genetic Analysis of the [Phi]C31-Specific Phage Growth Limitation (Pgl) System of Streptomyces Coelicolor A3(2)", Molecular Microbiology, 7(2): 329-336, 1993.

Laity et al. "Genetic Analysis of the Phi C31-Specific Phage Growth Limitation (Pgl) System of Streptomyces Coelicolor A3(2)", Molecular Microbiology, XP055168264, 7(2): 329-336, Jan. 1993.

Makarova et al. "Comparative Genomics of Defense Systems in Archaea and Bacteria", Nucleis Acids Research, 41(8): 4360-4377, Published Online Mar. 6, 2013.

Makarova et al. "Defense Islands in Bacterial and Archaeal Genomes and Prediction of Novel Defense Systems", Journal of Bacteriology, 193(21): 6039-6056, Nov. 2011.

Sumby et al. "Genetics of the Phage Growth Limitation (Pgl) System of Streptomyces Coelicolor A3(2)", Molecular Microbiology, XP002735696, 44(2): 489-500, Apr. 2002.

Wu et al. "Complete Genome Sequence of the Aerobic CO-Oxidizing Thermophile Thermomicrobium Roseum", PLoS One, XP055167939, 4(1): e4207-1-e4207-16, Jan. 16, 2009.

Wu et al. "Thermomicrobium Roseum DSM 5159 Plasmid, Complete Sequence", Database EMBL [Online], Retrieved From EBI Accession No. GenBank: CP001276.1, Database Accession No. CP001276, Jan. 8, 2015.

Communication Pursuant to Article 94(3) EPC dated Jan. 16, 2018 From the European Patent Office Re. Application No. 14796294.8.

Altschul et al. "Gapped BLAST and PSI-BLAST: a new generation of protein database search programs" Nucleic acids research. Sep. 1, 1997;25(17):3389-402.

Alva et al. "The MPI bioinformatics Toolkit as an integrative platform for advanced protein sequence and structure analysis" Nucleic acids research. Apr. 29, 2016;44(W1):W410-5.

Amann et al. "Vectors bearing a hybrid trp-lac promoter useful for regulated expression of cloned genes in *Escherichia coli*" Gene. Nov. 30, 1983;25(2):167-78.

Anantharaman et al. "Ter-dependent stress response systems: novel pathways related to metal sensing, production of a nucleoside-like metabolite, and DNA-processing" Molecular bioSystems. 2012;8(12):3142-65.

Balbás P. "Understanding the art of producing protein and nonprotein molecules in *Escherichia coli*" Molecular biotechnology. Dec. 1, 2001;19(3):251-67.

Baym et al. "Inexpensive multiplexed library preparation for megabase-sized genomes" PLoS One. May 22, 2015;10(5):e0128036.

Bian et al. "Effect of cell-based intercellular delivery of transcription factor GATA4 on ischemic cardiomyopathy" Circulation research. Jun. 8, 2007;100(11):1626-33.

Brosius et al. "Spacing of the-10 and-35 regions in the tac promoter. Effect on its in vivo activity" Journal of biological chemistry. Mar. 25, 1985;260(6):3539-41.

Camacho et al. "BLAST+: architecture and applications" BMC bioinformatics. Dec. 2009;10(1):421.

Capecchi MR. "Altering the genome by homologous recombination" Science. Jun. 16, 1989;244(4910):1288-92.

Caruthers et al. "Helicase structure and mechanism" Current opinion in structural biology. Feb. 1, 2002;12(1):123-33.

(56) References Cited

OTHER PUBLICATIONS

Caruthers et al. "Structure of the second domain of the Bacillus subtilis DEAD-box RNA helicase YxiN" Acta Crystallographica Section F: Structural Biology and Crystallization Communications. Dec. 1, 2006;62(12):1191-5.
Cury et al. "Integrative and conjugative elements and their hosts: composition, distribution and organization" Nucleic acids research. Jul. 13, 2017;45(15):8943-56.
Dangwal et al. "De novo methyltransferase, OsDRM2, interacts with the ATP-dependent RNA helicase, OseIF4A, in rice" Journal of molecular biology. Aug. 23, 2013:425(16):2853-66.
Dar et al. "Term-seq reveals abundant ribo-regulation of antibiotics resistance in bacteria" Science. Apr. 8, 2016:352(6282):aad9822.
Davies et al. "Plasmid-determined resistance to antimicrobial agents" Annual Reviews in Microbiology. Oct. 1978;32(1):469-508.
Deatherage et al. "Identification of mutations in laboratory-evolved microbes from next-generation sequencing data using breseq" In Engineering and analyzing multicellular systems 2014 (pp. 165-188). Humana Press, New York, NY.
De Boer et al. "The tac promoter: a functional hybrid derived from the trp and lac promoters" Proceedings of the National Academy of Sciences. Jan. 1, 1983;80(1):21-5.
Doron et al. "Systematic discovery of antiphacie defense systems in the microbial pangenome" Science. Mar. 2, 2018;359(6379):eaar4120.
Dunlap et al. "*Bacillus paralicheniformis* sp. nov., isolated from fermented soybean paste, International journal of systematic and evolutionary microbiology" Oct. 1, 2015;65(10):3487-92.
Dürr et al. "Snf2 family ATPases and DExx box helicases: differences and unifying concepts from high-resolution crystal structures" Nucleic acids research. Aug. 25, 2006;34(15):4160-7.
Dy et al. "A widespread bacteriophage abortive infection system functions through a Type IV toxin-antitoxin mechanism" Nucleic acids research, Jan. 24, 2014;42(7):4590-605.
Enright et al. "An efficient algorithm for large-scale detection of protein families" Nucleic acids research. Apr. 1, 2002;30(7):1575-84.
Fawell et al. "Tat-mediated delivery of heterologous proteins into cells" Proceedings of the National Academy of Sciences. Jan. 18, 1994;91(2):664-8.
Fingl et al., "General Principles." The Pharmacological Basis of Therapeutics (ed. Goodman, LS & Gilman, A,): 1-46 (1975).
Fortier et al. "Phage production and maintenance of stocks, including expected stock lifetimes" In Bacteriophages 2009 (pp. 203-219). Humana Press.
Freshney "Culture of animal cells: A manual of basic technique" (Culture of Animal Cells, A Manual of Basic Technique, Alan R. Liss, Inc., 1983, New York, p. 4).
GenBank Accession: DQ079897.1, Jan. 24, 2006.
GenBank Accession: KF669652.1, Jul. 8, 2014.
GenBank Accession: AB605730.1, Jul. 20, 2011.
GenBank Accession EU622808.1, May 6, 2009.
Gilboa E. "Transfer and expression of cloned genes using retroviral vectors" BioTechniques. 1986;4:504-12.
Goeddel et al. Synthesis of human fibroblast interferon by *E. coli*. Nucleic Acids Research. Sep. 25, 1980;8(18):4057-74.
Grazulis et al. "Structure of the metal-independent restriction enzyme BliI reveals fusion of a specific DNA-binding domain with a nonspecific nuclease" Proceedings of the National Academy of Sciences. Nov. 1, 2005;102(44):15797-802.
Hoskisson et al. "The phage growth limitation system in Streptomyces coelicolor A (3) 2 is a toxin/antitoxin system, comprising enzymes with DNA methyltransferase, protein kinase and ATPase activity" Virology. Mar. 1, 2015;477:100-9.
Itaya et al. "Construction and manipulation of giant DNA by a genome vector" In Methods in enzymology Jan. 1, 2011 (vol. 498, pp. 427-447). Academic Press.
Itaya et al. "Stable positional cloning of long continuous DNA in the Bacillus subtilis genome vector" Journal of biochemistry. Oct. 1, 2003;134(4):513-9.

Jakutyteet al. "Bacteriophage infection in rod-shaped gram-positive bacteria: evidence for a preferential polar route for phage SPP1 entry in Bacillus subtilis" Journal of bacteriology. Jun. 24, 2011:JB-05104.
Jakutyteet al. "First steps of bacteriophage SPP1 entry into Bacillus subtilis" Virology. Jan. 20, 2012;422(2):425-34.
Johnson et al. "Integrative and conjugative elements (ICEs): what they do and how they work" Annual review of genetics. Nov. 23, 2015;49:577-601.
Kelley et al. "The Phyre2 web portal for protein modeling, prediction and analysis" Nature protocols. Jun. 2015;10(6):845.
Kropinski et al. "Enumeration of bacteriophages by double agar overlay plaque assay" In Bacteriophages 2009 (pp. 69-76). Humana Press.
Krueger et al. "Bismark: a flexible aligner and methylation caller for Bisulfite-Seq applications. Bioinformatics" Apr. 14, 2011;27(11):1571-2.
Labrie et al. "Bacteriophage resistance mechanisms" Nature Reviews Microbiology. May 2010;8(5):317.
Li et al. "OrthoMCL: identification of ortholog groups for eukaryotic genomes" Genome research. Sep. 1, 2003;13(9):2178-89.
Marchler-Bauer et al. "CDD: a Conserved Domain Database for the functional annotation of proteins" Nucleic acids research. Nov. 24, 2010;39(suppl_1):D225-9.
Markowitz et al. "IMG: the integrated microbial genomes database and comparative analysis system" Nucleic acids research. Dec. 16, 2011;40(D1):D115-22.
Martin M. "Cutadapt removes adapter sequences from high-throughput sequencing reads" EMBnet, journal. May 2, 2011;17(1):pp. 10.
Mazzocco et al. "Enumeration of bacteriophages using the small drop plaque assay system" In Bacteriophages 2009 (pp. 81-85). Humana Press.
Menke DB. "Engineering subtle targeted mutations into the mouse genome" Genesis. Sep. 2013;51(9):605-18.
Miura et al "Amplification-free whole-genome bisulfite sequencing by post-bisulfite adaptor tagging" Nucleic acids research. May 30, 2012;40(17):e136-.
Noyer-Weidner et al. "M. phi 3TII: a new monospecific DNA (cytosine-C5) methyltransferase with pronounced amino acid sequence similarity to a family of adenine-N6-DNA-methyltransferases" Nucleic acids research. Dec. 11, 1994;22(24):5517.
Ofir e al. "DISARM is a widespread bacterial defence system with broad anti-phage activities" Nature microbiology. Jan. 2018;3(1):90.
Rachinger et al. "First insights into the completely annotated genome sequence of Bacillus licheniformis strain 9945A" Genome announcements. Aug. 29, 2013;1(4):e00525-13.
Radeck et al. "The Bacillus BioBrick Box: generation and evaluation of essential genetic building blocks for standardized work with Bacillus subtilis" Journal of biological engineering. Dec. 2013;7(1):29.
Raibaud et al. "Positive control of transcription initiation in bacteria" Annual review of genetics. Dec. 1984;18(1):173-230.
Roberts et al. "A nomenclature for restriction enzymes, DNA methyltransferases, homing endonucleases and their genes" Nucleic acids research. Apr. 1, 2003;31(7):1805-12.
Roberts et al. "REBASE—a database for DNA restriction and modification: enzymes, genes and genomes" Nucleic acids research. Nov. 5, 2014;43(D1):D298-9.
Robinson et al. "Integrative genomics viewer" Nature biotechnology. Jan. 10, 2011;29(1):24.
Sambrook et al. "Molecular cloning: a laboratory manual." Cold Spring Harbor Laboratory Press, Cold Spring Harbor, New York 2 (2001).
Santiago et al. "Targeted gene knockout in mammalian cells by using engineered zinc-finger nucleases" Proceedings of the National Academy of Sciences. Apr. 15, 2008;105(15):5809-14.
Sardana et al. "Physical and functional interaction between the methyltransferase Bud23 and the essential DEAH-box RNA helicase Ecm16" Molecular and cellular biology. Apr. 7, 2014:MCB-01656.
Sathiamoorthy et al. "Boundaries of the origin of replication: creation of a pET-28a-derived vector with p15A copy control allowing compatible coexistence with pET vectors" PloS one. Oct. 22, 2012;7(10):e47259.

(56) References Cited

OTHER PUBLICATIONS

Selvy et al. "Phospholipase D: enzymology, functionality, and chemical modulation" Chemical reviews. Sep. 22, 2011;111(10):6064-119.
Shimatake et al. "Purified λ regulatory protein cII positively activates promoters for lysogenic development" Nature. Jul. 1981;292(5819):128.
Singh et al. "Mobility of the native Bacillus subtilis conjugative plasmid pLS20 is regulated by intercellular signaling" PLoS genetics. Oct. 31, 2013;9(10):e1003802.
Söding et al. "The HHpred interactive server for protein homology detection and structure prediction" Nucleic acids research. Jul. 1, 2005;33(suppl_2):W244-8.
Stern et al. "The phage-host arms race: shaping the evolution of microbes" Bioessays. Jan. 2011;33(1):43-51.
Stoltenburg et al. "SELEX—a (r) evolutionary method to generate high-affinity nucleic acid ligands" Biomolecular engineering. Oct. 1, 2007;24(4):381-403.
Studier et al. "Use of bacteriophage T7 RNA polymerase to direct selective high-level expression of cloned genes" Journal of molecular biology. May 5, 1986;189(1):113-30.
Swarts et al. "DNA-guided DNA interference by a prokaryotic Argonaute" Nature. Mar. 2014;507(7491):258.
Tabor et al. "A bacteriophage T7 RNA polymerase/promoter system for controlled exclusive expression of specific genes" Proceedings of the National Academy of Sciences. Feb. 1, 1985;82(4):1074-8.
Tatusov et al. "The COG database: a tool for genome-scale analysis of protein functions and evolution" Nucleic acids research. Jan. 1, 2000;28(1):33-6.
Tatusov et al. "A genomic perspective on protein families" Science. Oct. 24, 1997;278(5338):631-7.
Theodore et al. "Intraneuronal delivery of protein kinase C pseudosubstrate leads to growth cone collapse" Journal of Neuroscience. Nov. 1, 1995;15(11):7158-67.
Thiaville et al. "Novel genomic island modifies DNA with 7-deazaguanine derivatives" Proceedings of the National Academy of Sciences. Mar. 15, 2016;113(11):E1452-9.
Titok et al. "Bacillus subtilis soil isolates: plasmid replicon analysis and construction of a new theta-replicating vector" Plasmid. Jan. 31, 2003;49(1):53-62.
Tzipilevich et al. "Acquisition of phage sensitivity by bacteria through exchange of phage receptors" Cell. Jan. 12, 2017:168(1-2):186-99.
Van Dongen et al. "Using MCL to extract clusters from networks" In Bacterial Molecular Networks 2012 (pp. 281-295). Springer, New York, NY.
Weigel et al. "Bacteriophage replication modules" FEMS microbiology reviews. May 1, 2006;30(3):321-81.
Wilson et al. "Nutritional factors influencing the development of competence in the Bacillus subtilis transformation system" Journal of bacteriology. Apr. 1, 1968;95(4):1439-49.
Wommack et al. "Methods for the isolation of viruses from environmental samples" In Bacteriophages 2009 (pp. 3-14). Humana Press.
Yelverton et al. "Bacterial synthesis of a novel human leukocyte interferon" Nucleic acids research. Feb. 11, 1981;9(3):731-41.
Zabala et al. "Optimization of the Tet-on system to regulate interleukin 12 expression in the liver for the treatment of hepatic tumors" Cancer research. Apr. 15, 2004;64(8):2799-804.
Zaremba et al. "DNA cleavage by CgII and NgoAVII requires interaction between N-and R-proteins and extensive nucleotide hydrolysis" Nucleic acids research. Nov. 27, 2014;42(22):13887-96.
Barrangou et al. "Mining for novel bacterial defense systems." Nature microbiology. May 2018;3(5):535.
Bernheim et al. "Inhibition of NHEJ repair by type II-A CRISPR-Cas systems in bacteria" Nature communications. Dec. 12, 2017;8(1):2094.
Database Protein [Online] May 18, 2015 (May 18, 2015), "hypothetical protein 84037_2532 [Bacillus cereus]", retrieved from NCBI Database accession No. KLA13162.1. abstract.
Database Protein [Online] Jul. 26, 2016 (Jul. 26, 2016), "hypothetical protein BF33_5602 (plasmid) [Bacillus cereus]", retrieved from NCBI Database accession No. AJK37459.1. abstract.
Doron et al. Supplementary Material for "Systematic discovery of antiphage defense systems in the microbial pangenome" vol. 359, No. 1008, 2018, retrieved from the Internet URL:http://science.sciencemag.org/content/suppl/2018/01/24/science.aar4120.DC1?ga=2.200364138.551305813.1534756856-897081808.1411380619.
Gleditzsch et al. "Modulating the Cascade architecture of a minimal Type IF CRISPR-Cas system" Nucleic acids research. May 23, 2016;44(12):5872-82.
Johnson et al. "Complete genome sequences for 35 biothreat assay-relevant *Bacillus* species" Genome Announc. Apr. 30, 2015;3(2):e00151-15.
Krawczyk et al. "Next-generation whole-genome sequencing of eight strains of Bacillus cereus, isolated from food" Genome Announc. Dec. 17, 2015;3(6):e01480-15.
Makarova et al. "A DNA repair system specific for thermophilic Archaea and bacteria predicted by genomic context analysis" Nucleic acids research. Jan. 15, 2002;30(2):482-96.
Makarova et al. "Evolution and classification of the CRISPR-Cas systems" Nature Reviews Microbiology. Jun. 2011;9(6):467.
Makarova et al. "An updated evolutionary classification of CRISPR-Cas systems" Nature Reviews Microbiology. Nov. 2015;13(11):722.
Ofir et al. "Contemporary phage biology: From classic models to new insights" Cell. Mar. 8, 2018;172(6):1260-70.
Sapranauskas et al. "The *Streptococcus thermophilus* CRISPR/Cas system provides immunity in *Escherichia coli*" Nucleic acids research. Aug. 3, 2011;39(21):9275-82.
"Thermomicrobium roseum DSM 5159 plasmid, complete sequence", 2015, Database EMBL.., (Jan. 26, 2009), Database accession No. CP001276.

\* cited by examiner

FIG. 2

```
Streptomyces coelicolor A3(2)    39  LRDYVVTERLLENFDEALALIKSSLDGHRSK-AAYLHGSFGSGKSHFMAVLYALLSG  94
(SCO6835) 39-94
SEQ ID NO: 6223                      L +YVVT    LL +  E    K    + GH  K   ++ G  ++ G  ++ LL Bacillus cereus H3081.97         33  LDEYVVTNELLHHMGEFFKSYKKGITGHTDKMGVWISGFFGSGKSHFLKILSYLLEN  89
(BCB08197_0965) 33-89
SEQ ID NO: 6224
```

P-loop

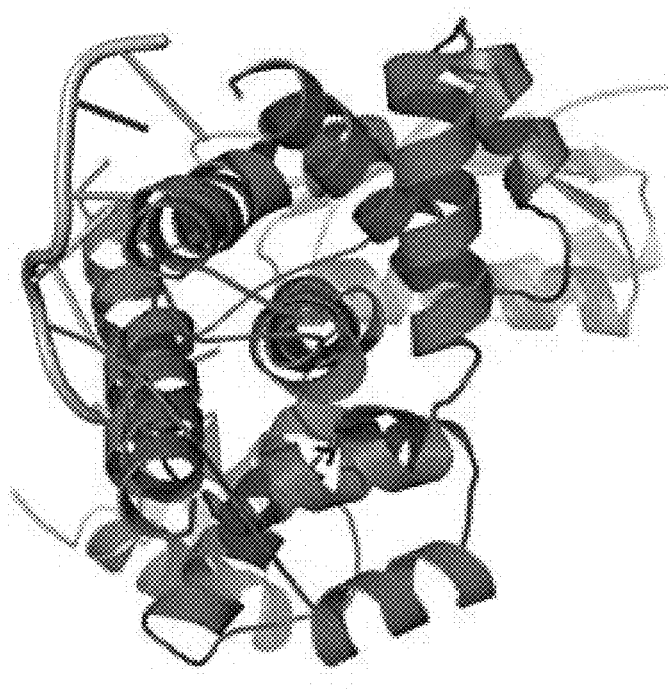
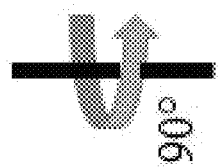
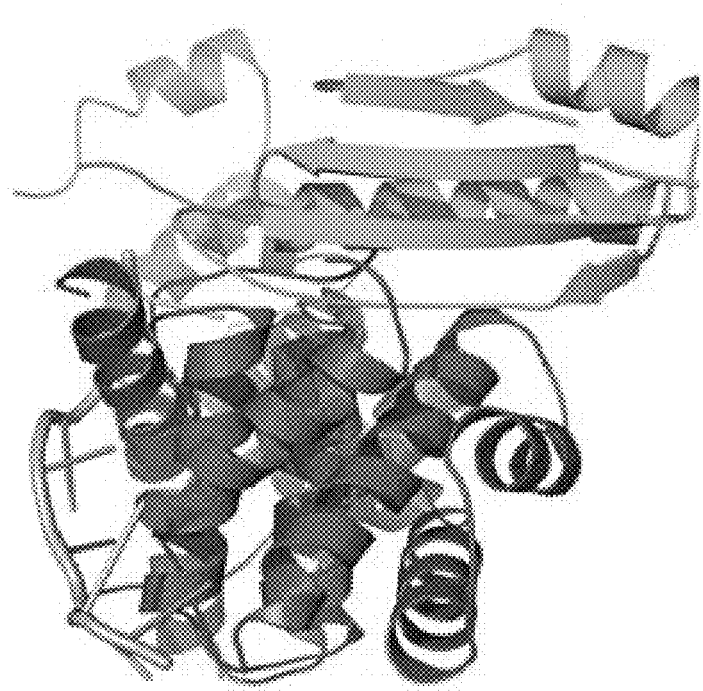
FIG. 3

FIG. 4D  FIG. 4F  FIG. 4H
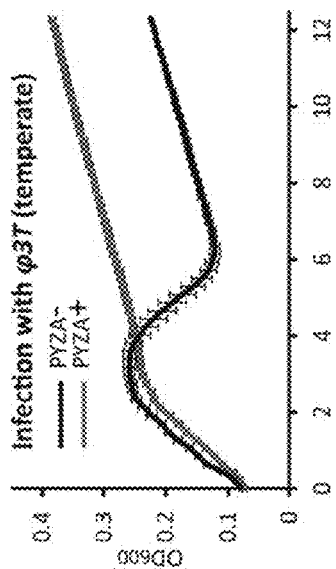
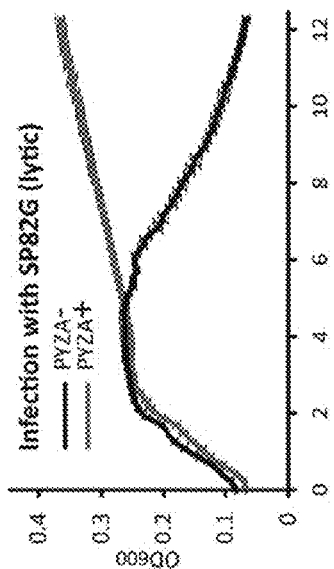
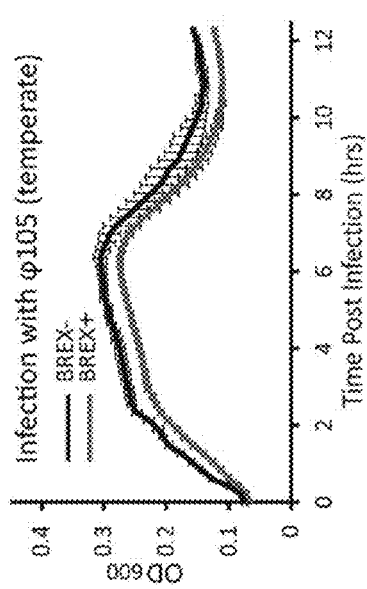
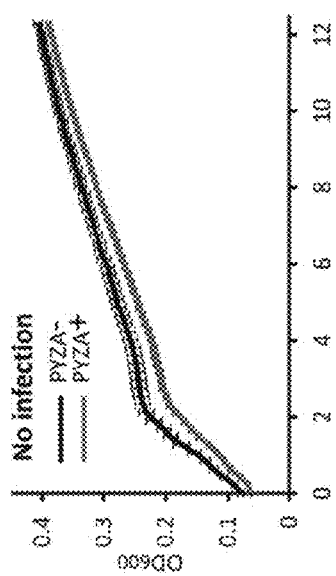
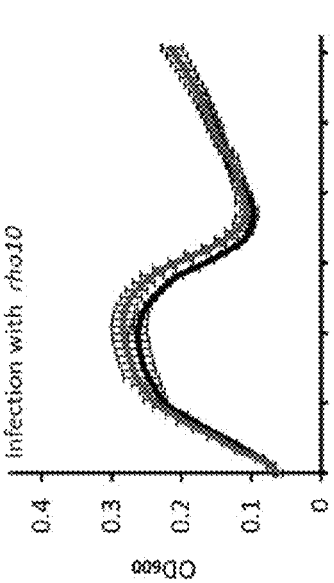
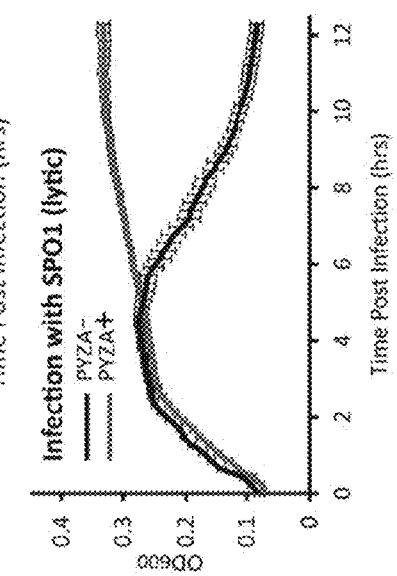
FIG. 4C  FIG. 4E  FIG. 4G

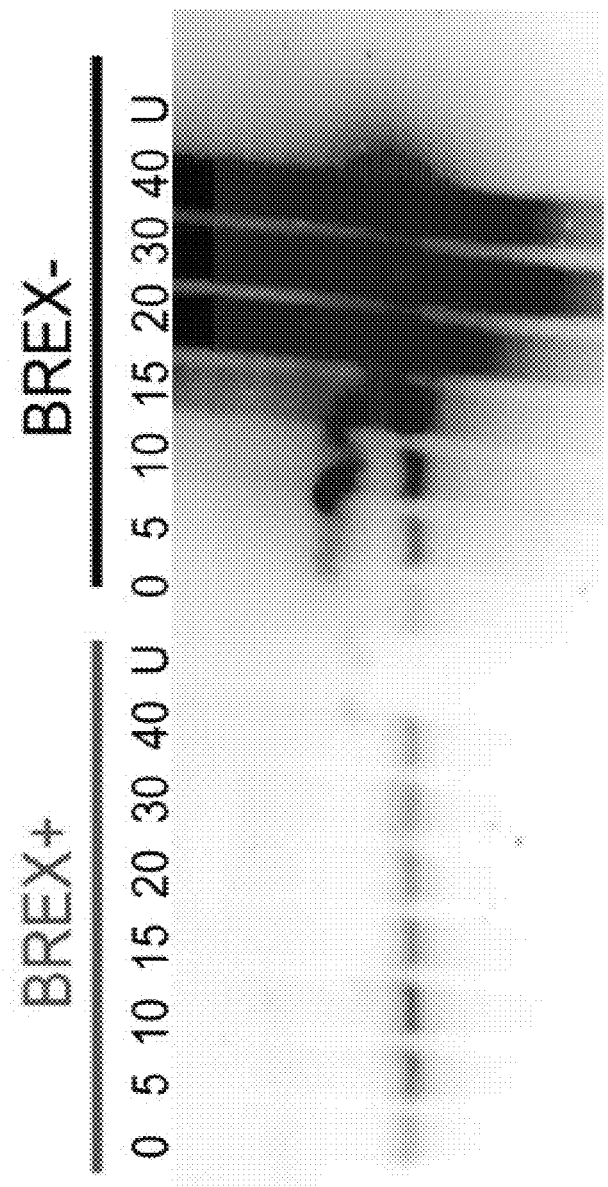

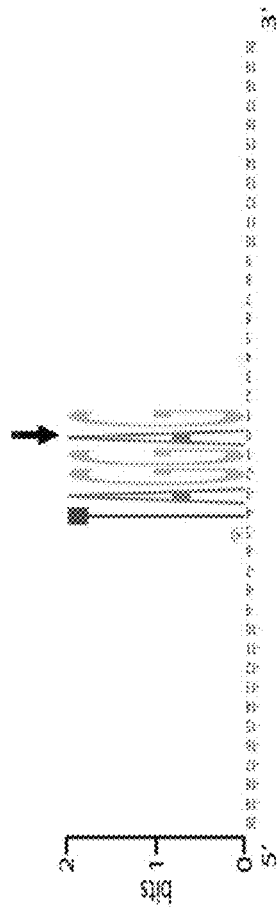
FIG. 13A
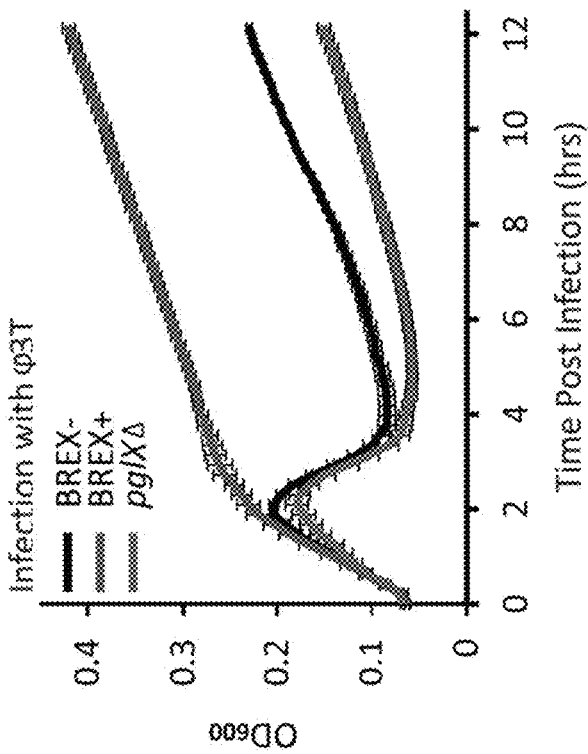
FIG. 13B
| Motif | # in genome | # identified as modified | % modified |
|---|---|---|---|
| TAGGAG | 865 | 820 | 94.80% |
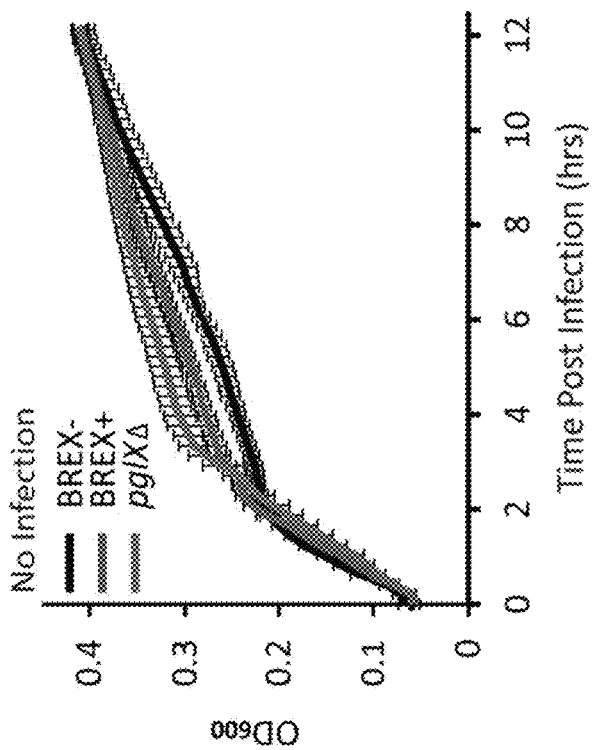
FIG. 14A
FIG. 14B

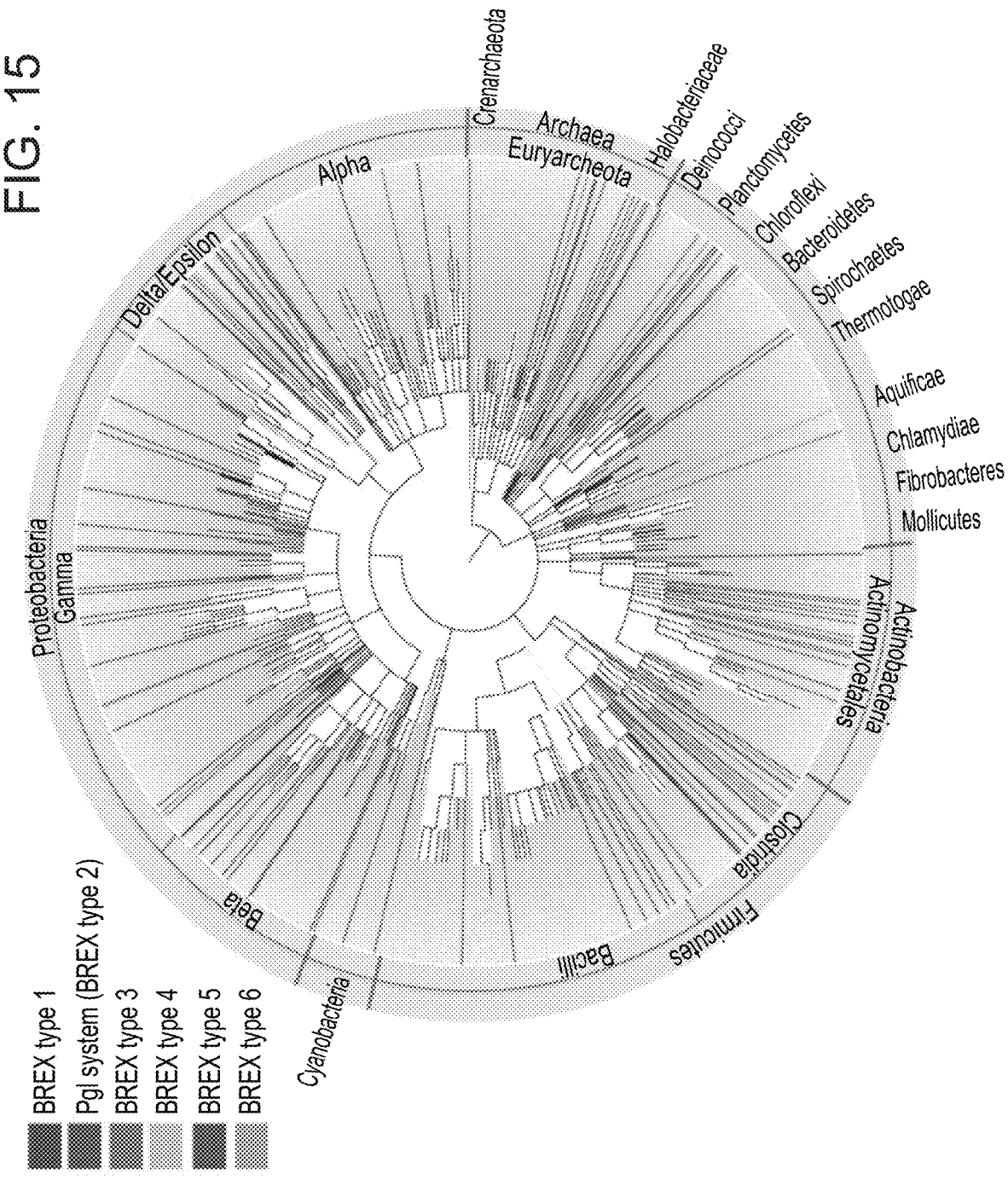

POLYNUCLEOTIDES ENCODING BREX SYSTEM POLYPEPTIDES AND METHODS OF USING SAME

RELATED APPLICATIONS

This application is a National Phase of PCT Patent Application No. PCT/IL2014/050902 having International filing date of Oct. 14, 2014, which claims the benefit of priority under 35 USC § 119(e) of U.S. Provisional Patent Application No. 61/894,993 filed on Oct. 24, 2013. The contents of the above applications are all incorporated by reference as if fully set forth herein in their entirety.

SEQUENCE LISTING STATEMENT

The ASCII file, entitled 65640SequenceListing.txt, created on Apr. 21, 2016, comprising 61,303,214 bytes, submitted concurrently with the filing of this application is incorporated herein by reference.

FIELD AND BACKGROUND OF THE INVENTION

The present invention, in some embodiments thereof, relates to polynucleotides encoding BREX system polypeptides and methods of using same.

The ongoing arms race between bacteria and bacteriophages (phages) has led to the rapid evolution of efficient resistance systems to protect bacteria from phage infection (Stern and Sorek, 2011). These systems include restriction-modification systems enzymes that recognize and cleave foreign DNA (King and Murray, 1994), abortive infection (Abi) mechanisms that lead to the suicide of the infected host, thus protecting the colony against phage spread (Chopin et al., 2005), and the CRISPR/Cas adaptive defense system, which uses small RNAs to target and destroy invading phage DNA (Deveau et al., 2010). On the counter arm, as part of this continuous bacteria and phages arms race, successful phages had also developed numerous counter-resistance mechanisms to overcome bacterial defense (Stern and Sorek, 2011). Due to the rapid evolution and elaborated biological novelty associated with the bacteria-phage arms race, it is estimated that many additional, yet uncharacterized anti-phage defense systems are encoded by bacteria and archaea genomes (Stern and Sorek, 2011).

A broad array of food products, commodity chemicals, and biotechnology products are manufactured industrially by large-scale bacterial fermentation of various substrates. Enormous amounts of bacteria are being cultivated each day in large fermentation vats, thus phage contamination can rapidly bring fermentations to a halt and cause economic setbacks, and is therefore considered a serious threat in these industries. The dairy fermentation industry has openly acknowledged the problem of phage and has been working with academia and starter culture companies to develop defense strategies and systems to curtail the propagation and evolution of phages for decades.

Anti-microbial phage therapy dates back to the early 1900s, after their co-discovery by Frederick Twort and Felix d'Hérelle (Twort F W 1915; and D'Hérelle 1917). Over the last decade a marked increase in interest in the therapeutic use of phages has been observed, which has resulted due to a substantial rise in the prevalence of antibiotic resistance of bacteria, coupled with an inadequate number of new antibiotics (Miedzybrodzki R et al., 2012). Properly formulated and applied phages have sufficient potential to cure bacterial infections. The key advantage of phages as anti-microbial therapeutic agents is their potential to negatively impact only their specific bacterial targets. Other advantages include, for example, an increase in phage number over the course of treatment, tendency to only minimally disrupt normal flora, capability of disrupting bacterial biofilms, low inherent toxicities, and most importantly effectiveness against both antibiotic-sensitive and antibiotic-resistant bacteria.

In 1982, Chinenova and colleagues reported a unique phage defense phenotype in *Streptomyces coelicolor* A3(2), which was denoted Phage Growth Limitation (PGL) (Chinenova T. A. et al, 1982). In their work Chinenova et al. demonstrated that upon the first cycle of infection by the ΦC31 phage, *Streptomyces coelicolor* A3 was phage-sensitive and supported phage burst. However, phages emerging from this first cycle of infection could not successfully re-infect the *Streptomyces coelicolor* A3 host. Intriguingly, these phages were able to successfully infect strains of *Streptomyces* that do not carry the PGL system (Chinenova T. A. et al, 1982).

Further studies mapped the phenotype to a cluster of four genes, denoted pglW, pglX, pglY and pglZ, which were shown to reconstitute the above described PGL phenotype upon transfer to a PGL host (Sumby. P. & Smith, M. C. 2002). Of note, introduction of pglY and pglZ$^-$ was not sufficient to confer a PGL+ phenotype in all mutants tested (Laity et al., 1993; Sumby et al. 2002). The domains encoded within these four genes do not resemble any classical combination of genes currently known to be involved in phage defense: pglZ is a member of the alkaline phosphatase superfamily; pglW has a serine/threonine kinase domain; pglX is an adenine-specific DNA methyltransferase; and pglY contains a p-loop ATPase domain (Sumby, P. & Smith, M. C. 2002). The PGL system described to date was not active against any other phage except for ΦC31 and its homoimmune relatives (Sumby. P. & Smith, M. C. 2002; Laity, C. et al. 1993).

A major characteristic of the PGL system described to date is the initial release of phage from the first infectious cycle followed by the attenuation of phage growth in the second. Various combinations of genes belonging to the PGL system, and predominantly pglZ, were found to be enriched within 'defense islands' (typical clustering of genes encoding defense system components in microbial genomes), providing additional support to the general involvement of these genes in a complex anti-phage defense system in multiple species (Makarova, K. S. et al. 2011; Makarova, K. S. et al. 2013). The discovery of the PGL system as an additional line of defense in bacteria may shed more light on the complex bacteria and phage arms race. However, a molecular mechanism that explains the activity of the PGL system has not yet been solved. Profound understanding of the molecular mechanism of this system might prove to be a powerful and economically important tool in molecular engineering applications (as was previously demonstrated with other complex phage resistance systems such as CRISPR-Cas).

SUMMARY OF THE INVENTION

According to an aspect of some embodiments of the present invention there is provided an isolated polynucleotide encoding a BREX system comprising a nucleic acid sequence encoding the BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW, and wherein the BREX system confers phage resistance to a bacteria recombinantly expressing same.

According to an aspect of some embodiments of the present invention there is provided an isolated polynucleotide encoding a BREX system comprising a nucleic acid sequence encoding the BREX system comprising brxC/pglY, pglZ, pglX, pglW and at least one of brxD and brxHI, and wherein the BREX system confers phage resistance to a bacteria recombinantly expressing same.

According to an aspect of some embodiments of the present invention there is provided an isolated polynucleotide comprising a nucleic acid sequence encoding a BREX system comprising:
(i) brxA, brxB, brxC/pglY, pglX, pglZ and brxL;
(ii) brxA, brxB, (brxC/pglY)$_{x2}$, pglX, pglZ and brxHII;
(iii) brxE, brxA, brxB, brxC/pglY, pglX, pglZ, brxD and brxHI;
(iv) brxF, brxC/pglY, pglXI, brxHII, pglZ and brxA;
(v) pglW, pglX, brxC/pglY, pglZ, brxD and brxHI; or
(vi) brxP, brxC/pglY, pglZ and brxL.

According to some embodiments of the invention, the nucleic acid construct comprising the polynucleotide encoding the BREX system further comprises a cis-acting regulatory element for directing expression of the nucleic acid sequence.

According to an aspect of some embodiments of the present invention there is provided a nucleic acid construct system comprising at least two nucleic acid constructs expressing a BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW.

According to an aspect of some embodiments of the present invention there is provided a nucleic acid construct system comprising at least two nucleic acid constructs expressing a BREX system comprising brxC/pglY, pglZ, pglX, pglW and at least one of brxD and brxHI.

According to an aspect of some embodiments of the present invention there is provided a phage defense composition, comprising as an active ingredient a BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW, or comprising brxC/pglY, pglZ, pglX, pglW and at least one of brxD and brxHI; and an acceptable carrier or diluent.

According to some embodiments of the invention, the nucleic acid construct or the composition comprises the BREX system formulated in a formulation suitable for cell penetration.

According to an aspect of some embodiments of the present invention there is provided an isolated cell genetically modified to express a BREX system selected from the group consisting of
(1) brxC/pglY, pglZ and at least one of pglX, pglXI, brxP, brxHI, brxHII, brxL, brxD, brxA, brxB, brxF, and brxE, with the proviso that the BREX system does not comprise pglW,
(2) brxC/pglY, pglZ, pglX, pglW and at least one of brxD and brxHI.
(3i) brxA, brxB, brxC/pglY, pglX, pglZ and brxL,
(3ii) brxA, brxB, (brxC/pglY)$_{x2}$, pglX, pglZ and brxHII,
(3iii) brxE, brxA, brxB, brxC/pglY, pglX, pglZ, brxD and brxHI,
(3iv) brxF, brxC/pglY, pglXI, brxHII, pglZ and brxA,
(3v) pglW, pglX, brxC/pglY, pglZ, brxD and brxHI, or
(3vi) brxP, brxC/pglY, pglZ and brxL.

According to some embodiments of the invention, the genetically modified cell further being resistant to a first cycle phage infection.

According to some embodiments of the invention, the genetically modified cell being resistant to phage lysogeny.

According to some embodiments of the invention, the genetically modified cell being resistant to lytic phage.

According to some embodiments of the invention, the genetically modified cell being resistant to phage DNA replication.

According to an aspect of some embodiments of the present invention there is provided an isolated cell genetically modified to express a BREX system polypeptide selected from the group consisting of pglXI, brxP, brxHI, brxHII, brxL, brxD, brxA, brxB, brxF, and brxE.

According to some embodiments of the invention, the isolated cell does not express a BREX system endogenously.

According to some embodiments of the invention, there is provided a method of protecting bacteria from phage attack, the method comprising expressing in the bacteria the isolated polynucleotide or the nucleic acid construct, thereby protecting the bacteria from phage attack.

According to an aspect of some embodiments of the present invention there is provided a method of protecting first bacteria from phage attack, the method comprising contacting the first bacteria with second bacteria which expresses on a transmissible genetic element a BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW, or comprising brxC/pglY, pglZ, pglX, pglW and at least one of brxD and brxHI, wherein the first bacteria and the second bacteria are non identical; thereby protecting the bacteria from phage attack.

According to some embodiments of the invention, the first bacteria does not express a BREX system endogenously.

According to some embodiments of the invention, the bacteria does not express a BREX system endogenously.

According to some embodiments of the invention, the phage is selected from the group consisting of SPβ, SP16, Zeta, Φ3T and SPO2.

According to some embodiments of the invention, the phage is not Φ105, rho10 and rho14.

According to some embodiments of the invention, the phage is a lytic phage.

According to some embodiments of the invention, the lytic phage is SPO1 and/or SP82G.

According to an aspect of some embodiments of the present invention there is provided an isolated bacteria comprising a nucleic acid sequence encoding a BREX system and a transmissible genetic element expressing the BREX system, wherein the isolated bacteria do not endogenously express the BREX system and wherein the BREX system comprises brxC/pglY, pglZ and at least one of pglX, pglXL, brxP, brxHI, brxHII, brxL, brxD, brxA, brxB, brxF, and brxE, with the proviso that the BREX system does not comprise pglW, or comprises brxC/pglY, pglZ, pglX, pglW and at least one of brxD and brxHI.

According to some embodiments of the invention, the BREX system is type 1 comprising brxA, brxB, brxC/pglY, pglX, pglZ and brxL.

According to some embodiments of the invention
(i) brxC/pglY is selected from the group of SEQ ID NO: 3-155, 157-765 and 767-1175,
(ii) pglZ is selected from the group of SEQ ID NO: 1176-1318, 1320-1856, 1858-2250, 6204 and 6205, (iii) pglX is selected from the group of SEQ ID NO: 2251-3280 and 6186-6201.
(iv) pglXI is selected from the group of SEQ ID NO: 3281-3296, 3298-3356 and 3358-3403,
(v) brxP is selected from the group of SEQ ID NO: 3404-3440,
(vi) brxHI is selected from the group of SEQ ID NO: 3543-3642,
(vii) brxHII is selected from the group of SEQ ID NO: 3441-3460, 3462-3511 3513-3542 and 6173-6185,
(viii) brxL is selected from the group of SEQ ID NO: 3643-4412, 6165, 6166, 6169, 6170, 6202 and 6203.
(ix) brxD is selected from the group of SEQ ID NO: 4413-4488.
(x) brxA is selected from the group of SEQ ID NO: 4489-4621, 4623-5086, 5088-5415, 6167, 6168, 6171 and 6172,
(xi) brxB is selected from the group of SEQ ID NO: 5416-5947, 6206-6209,
(xii) brxF is selected from the group of SEQ ID NO: 5948-5957, 5959-5988 and 5990-6028.
(xiii) brxE is selected from the group of SEQ ID NO: 6029-6040, and
(xiv) pglW is selected from the group of SEQ ID NO: 6041-6138.

According to an aspect of some embodiments of the present invention there is provided a method of inducing phage sensitivity in a bacterial cell, the method comprising contacting a bacterial cell which expresses a BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW, or comprising brxC/pglY, pglZ, pglX, pglW and at least one of brxD and brxHI; with an anti BREX system agent capable of down regulating a BREX gene selected from the group consisting of brxC/pglY, pglZ, pglX, pglXI, brxP, brxHI, brxHII, brxL, brxD, brxA, brxB, brxF, brxE, and pglW, thereby inducing sensitivity of the bacterial cell to phage infection.

According to some embodiments of the invention, the contacting is effected ex-vivo or in-vitro.

According to some embodiments of the invention, the contacting is effected in-vivo.

According to some embodiments of the invention, there is provided an isolated bacteria generated according to the method.

According to some embodiments of the invention, there is provided a method for preparing a food, food additive, feed, nutritional supplement, probiotic supplement, a personal care product, a health care product, and a veterinary product comprising adding to the food, food additive, feed, nutritional supplement, probiotic supplement, a personal care product, a health care product, and a veterinary product the isolated polynucleotide, the construct, the composition, the isolated cell or the bacteria, thereby preparing the food, food additive, feed, nutritional supplement, probiotic supplement, personal care product, health care product, and veterinary product.

According to an aspect of some embodiments of the present invention there is provided a method for preparing a food, food additive, feed, nutritional supplement, probiotic supplement, a personal care product, a health care product, and a veterinary product comprising adding to the food, food additive, feed, nutritional supplement, probiotic supplement, a personal care product, a health care product, and a veterinary product a bacteria which expresses on a transmissible genetic element a BREX system comprising brxC/pglY, pglZ and at least one of pglX, pglXI, brxP, brxHI, brxHII, brxL brxD, brxA, brxB, brxF, and brxE, with the proviso that the BREX system does not comprise pglW, or comprising brxC/pglY, pglZ, pglX, pglW and at least one of brxD and brxHI, thereby preparing the food, food additive, feed, nutritional supplement, probiotic supplement, personal care product, health care product, and veterinary product.

According to some embodiments of the invention, the transmissible genetic element comprises a conjugative genetic element or mobilizable genetic element.

According to some embodiments of the invention, the food or feed is a dairy product.

According to some embodiments of the invention, the cell is a bacteria.

According to some embodiments of the invention, the bacteria is a species selected from the group consisting of *Escherichia, Shigella, Salmonella, Erwinia, Yersinia, Bacillus, Vibrio, Legionella, Pseudomonas, Neisseria, Bordetella, Helicobacter, Listeria, Agrobacterium, Staphylococcus, Streptococcus, Enterococcus, Clostridium, Corynebacterium, Mycobacterium, Treponema, Borrelia, Francisella, Brucella, Campylobacter, Klebsiella, Frankia, Bartonella, Rickettsia, Shewanella, Serratia, Enterobacter, Proteus, Providencia, Brochothrix*, and *Brevibacterium*.

According to some embodiments of the invention, the bacteria is a lactic acid bacteria.

According to some embodiments of the invention, the bacteria is a species selected from the group consisting of *Lactococcus* species, *Streptococcus* species, *Lactobacillus* species, *Leuconostoc* species, *Oenococcus* species, *Pediococcus* species, *Bifidobacterium*, and *Propionibacterium* species.

According to some embodiments of the invention, there is provided a food, food additive, feed, nutritional supplement, probiotic supplement, a personal care product, a health care product, and a veterinary product comprising the isolated polynucleotide, the construct, the composition, the isolated cell or the isolated bacteria.

According to some embodiments of the invention, the product further comprises a dairy product.

According to an aspect of some embodiments of the present invention there is provided a method of treating a microbial infection in a subject in need thereof, the method comprising contacting the bacteria with an anti BREX system agent capable of down regulating a BREX gene selected from the group consisting of brxC/pglY, pglZ, pglX, pglXI, brxP, brxHI, brxHII, brxL, brxD, brxA, brxB, brxF, brxE, and pglW, thereby treating the infection.

According to some embodiments of the invention, the method further comprising administering to the subject a phage therapy.

According to some embodiments of the invention, the method further comprising administering to the subject an antibiotic.

According to some embodiments of the invention, the method further comprising administering to the subject a phage therapy and/or an antibiotic.

According to an aspect of some embodiments of the present invention there is provided an article of manufacture identified for killing a bacteria comprising a packaging material packaging an anti BREX system agent capable of down regulating a BREX gene selected from the group consisting of brxC/pglY, pglZ, pglX, pglXI, brxP, brxHI, brxHII, brxL, brxD, brxA, brxB, brxF, brxE, and pglW, and a phage.

According to an aspect of some embodiments of the present invention there is provided an anti-microbial composition comprising as active ingredient an anti BREX system agent capable of down regulating a BREX gene selected from the group consisting of brxC/pglY, pglZ, pglX, pglXI, brxP, brxHI, brxHII, brxL, brxD, brxA, brxB, brxF, brxE, and pglW, and an acceptable carrier or diluent.

According to some embodiments of the invention, the composition further comprising a phage.

According to some embodiments of the invention, the anti BREX system agent is administered in a formulation suitable for cell penetration.

According to some embodiments of the invention, the anti BREX system agent is selected from the group consisting of a nucleic acid suitable for silencing expression, aptamers, small molecules and inhibitory peptides.

According to some embodiments of the invention, the anti BREX system agent is directed against pglX.

According to some embodiments of the invention, the anti BREX system agent is directed against brxC/pglY or pglZ.

According to an aspect of some embodiments of the present invention there is provided a method of screening for identifying phage useful for infecting a bacteria, the method comprising:

(a) contacting a phage with a bacteria expressing BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW or comprising pglY, brxC/pglZ, pglX, pglW and at least one of brxD and brxHI;

(b) monitoring phage sensitivity of the bacteria, wherein an increase in phage sensitivity of the bacteria in the presence of the phage compared to phage sensitivity in the absence of the phage is indicative of a phage useful for infecting the bacteria.

According to some embodiments of the invention, the carrier is a pharmaceutically acceptable carrier.

According to some embodiments of the invention, the BREX system is characterized by at least one of
(i) not being an abortive infection system;
(ii) not being a restriction modification system;
(iii) not preventing phage adsorption to a bacteria expressing same.

According to some embodiments of the invention, the pglX is a methylase.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

Figure 1A:
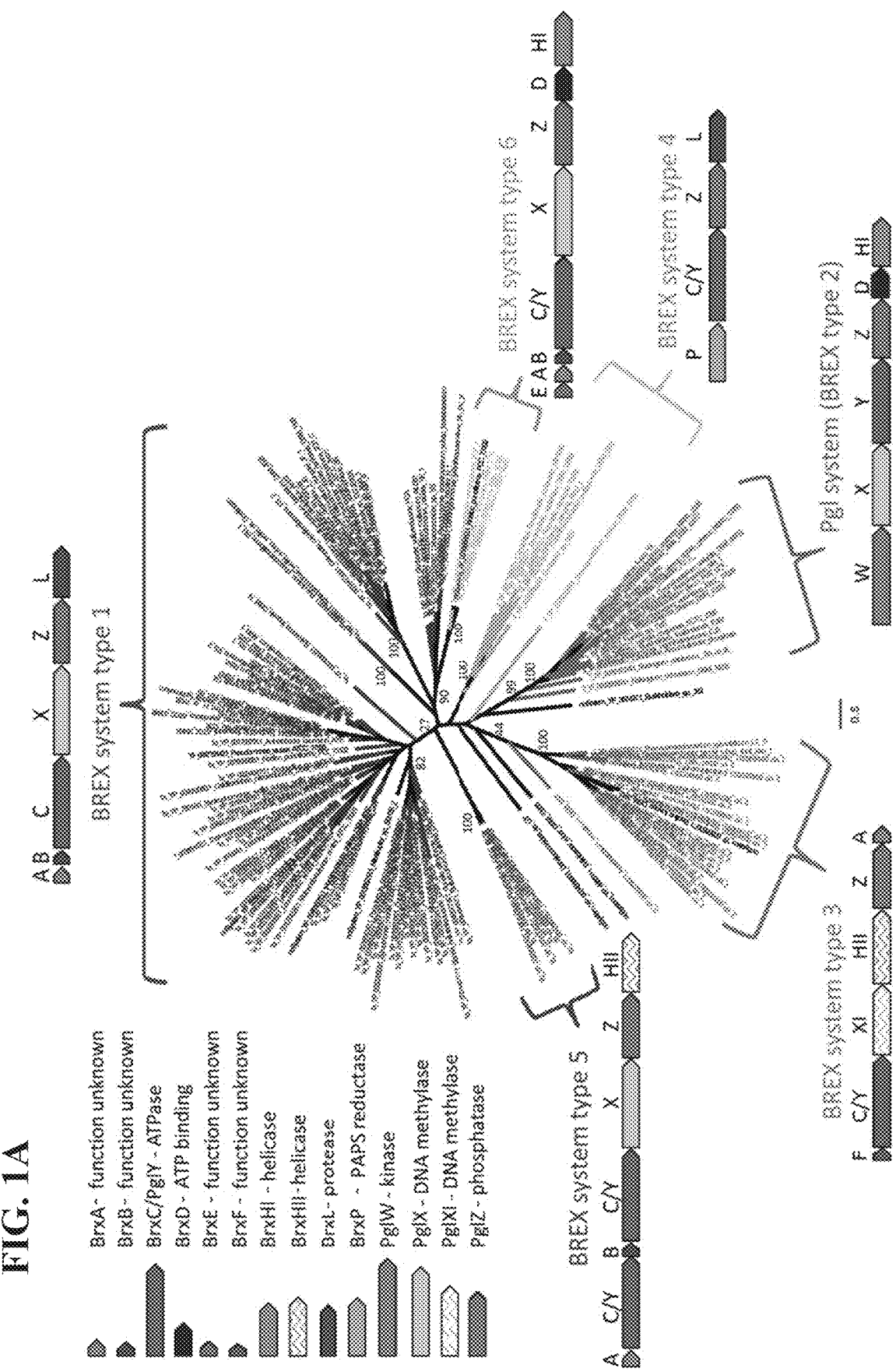
Figure 1B:
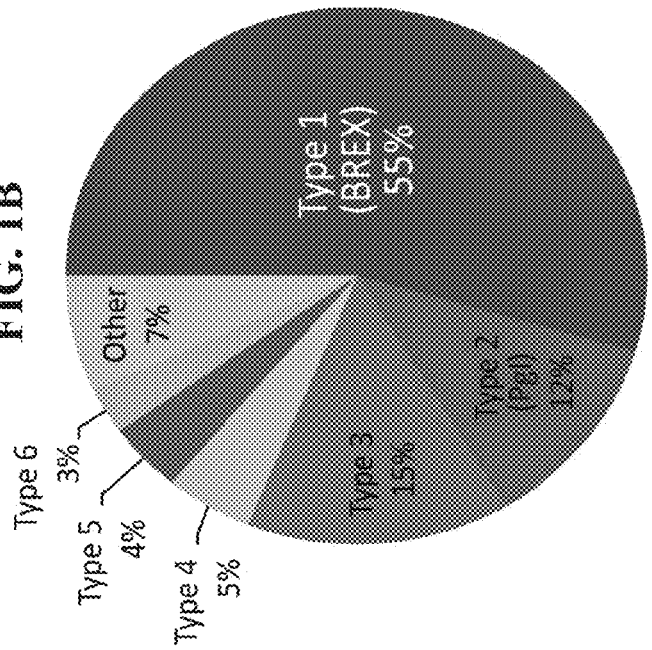
Figure 1C:
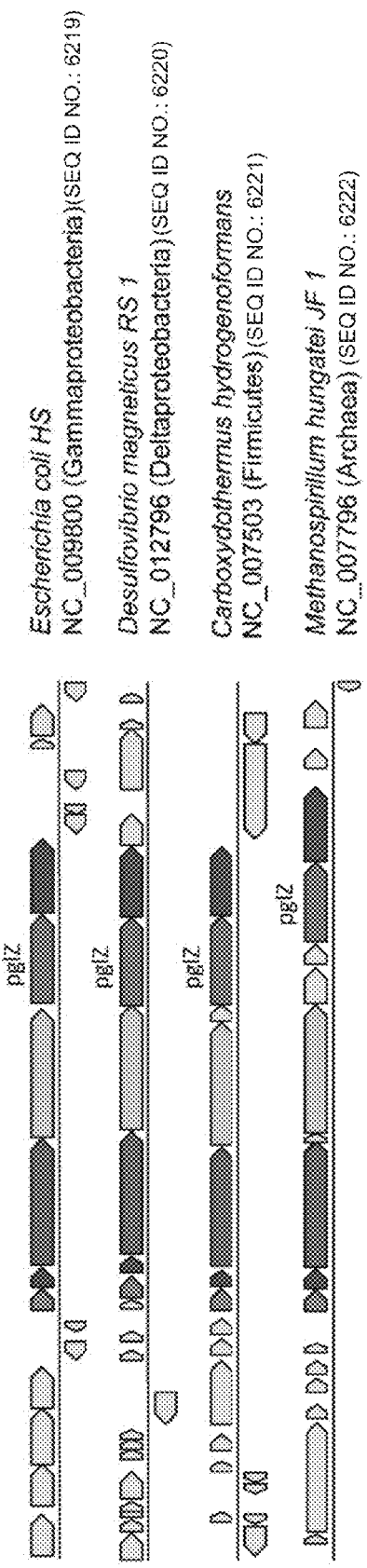

FIGS. 1A-C demonstrate pglZ phylogeny and the classification of Bacteriophage Exclusion (BREX) subtypes. FIG. 1A is a phylogenetic tree representing pglZ protein occurrences. The tree is color coded according to the different BREX subtypes. Gene order and genomic organization of each BREX subtype is illustrated next to its relevant branch on the pglZ tree. Numbers depict bootstap values. FIG. 1B is a pie chart demonstrating the prevalence of the different BREX subtypes within the BREX superfamily system among the sequenced genomes that were analyzed. FIG. 1C shows representative appearances of the pglZ gene in a type 1 BREX six-gene cluster.

FIG. 2 shows local alignment between brxC from *Bacillus cereus* H3081.97 (type 1 BREX) and pglY from *Streptomyces coelicolor* A3(2) (type 2 BREX) demonstrating that the alignment between the two genes spans the P-loop domain [GXXXXGK(T/S), DUF2791, SEQ ID NO: 6162)]. Alignment coverage: 4%, e-value: 8e-09, identity: 24/57 (42%). Locus tags marked in parentheses.

FIG. 3 shows the structural alignment between brxA from *Magnetospirillum magneticum* (PDB entry 3BHW) and NusB from *Aquifex aelicus* (PDB entry 3R2C) demonstrating structural homology between brxA and NusB. BrxA is marked in red; NusB is marked in blue; NusE is marked in cyan; RNA is marked in grey. Alignment length: 44 amino acids.

Figures 4A, 4B:
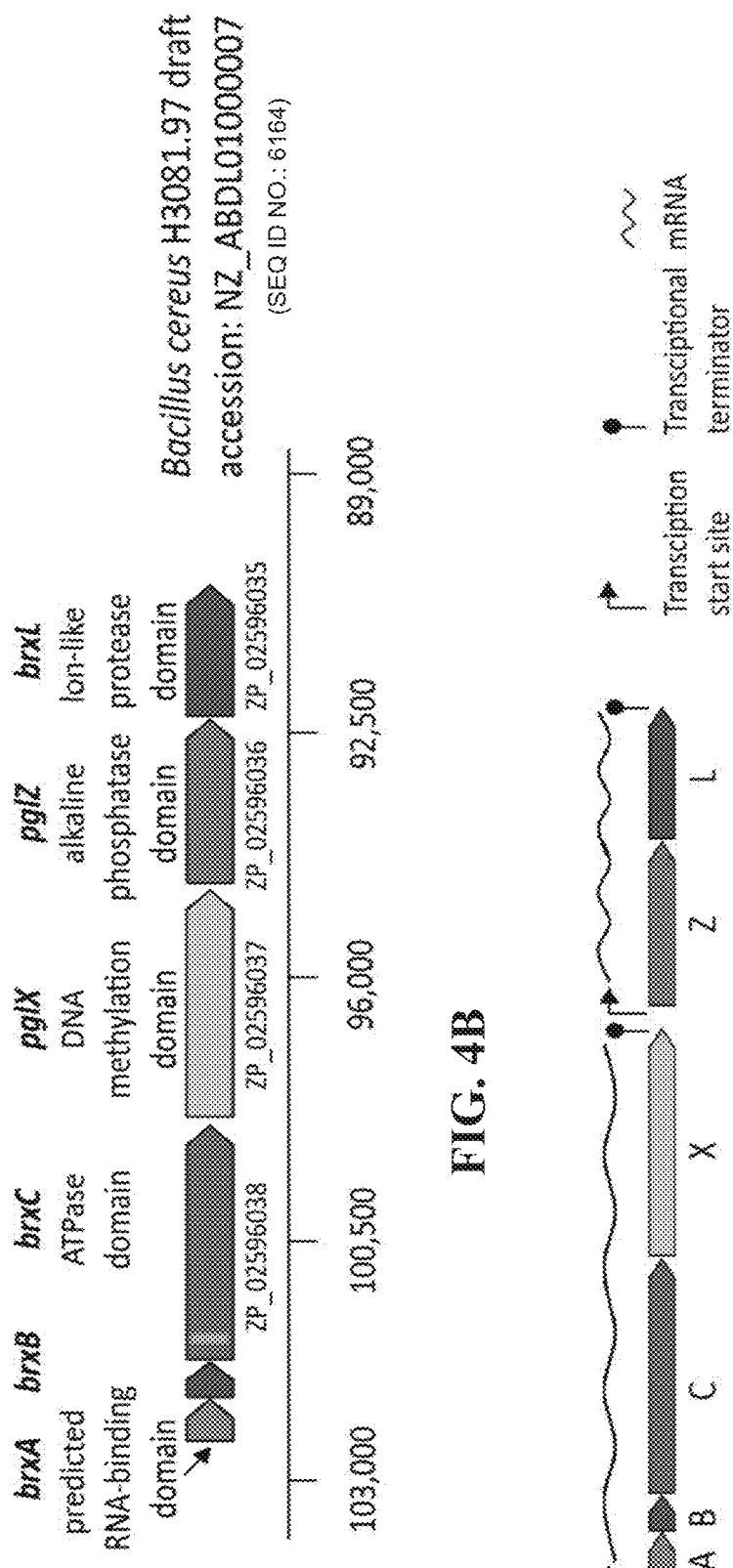
Figure 4I:
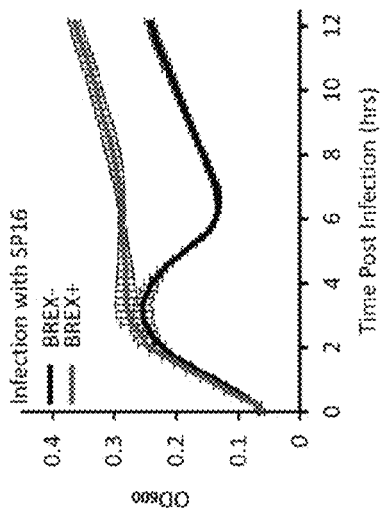
Figure 4J:
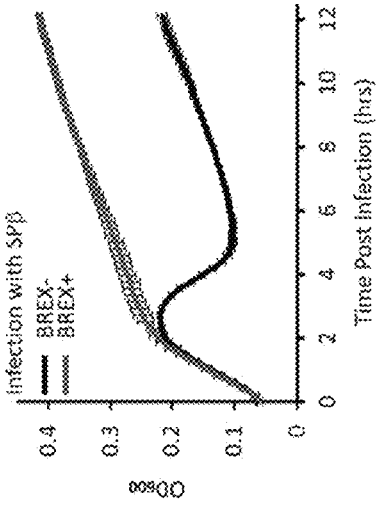
Figure 4K:
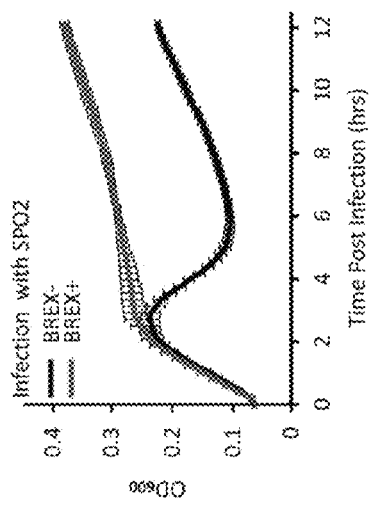
Figure 4L:
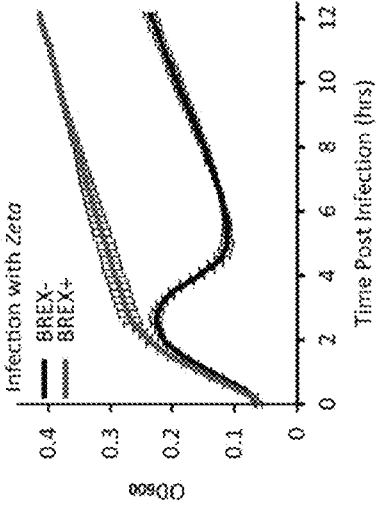

FIGS. 4A-M demonstrate that integration of type 1 BREX system from *Bacillus cereus* H3081.97 into *Bacillus subtilis* BEST7003 strain confers resistance of the latter to phage infection. FIG. 4A depicts the type 1 BREX locus in *Bacillus cereus* H3081.97. Coordinates below the genes denote the position along the NZ_ABDLO1000007 contig in the draft genome of *Bacillus cereus* H3081.97. The orange box within brxC represents the position of the ATPase p-loop motif. FIG. 4B depicts the operon organization of the *Bacillus cereus* BREX system integrated in the *Bacillus subtilis* genome. FIGS. 4C-F are bivariate graphs indicating 12 hours culture dynamics of the control strain (BREX⁻, black) versus type 1 BREX-containing (red) strain of *Bacillus subtilis* following infection with different phages, as evaluated by optical density measurements in a 96-well plate format. Bacterial strains were exposed to phage at Time=0. Each graph represents 3 experiments with three technical triplicates for each biological replicate. Error bars represent SEM. FIG. 4C illustrates non-infected control (BREX⁻) and type 1 BREX-containing *Bacillus subtilis* cultures. FIGS. 4D-M illustrate culture dynamics of the BREX⁻ and type 1 BREX-containing *Bacillus subtilis* cultures following infection with Φ3T (FIG. 4D), rho10 (FIG. 4E), SP82G (FIG. 4F), SPO1 (FIG. 4G), 0105 (FIG. 4H), SPO2 (FIG. 4I), SP16 (FIG. 4J), Zeta (FIG. 4K), SPβ (FIG. 4L), and rho14 (FIG. 4M) phages.

Figure 5A:
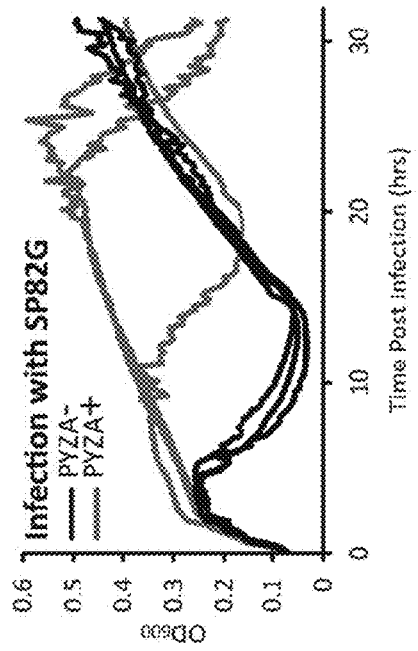
Figure 5B:
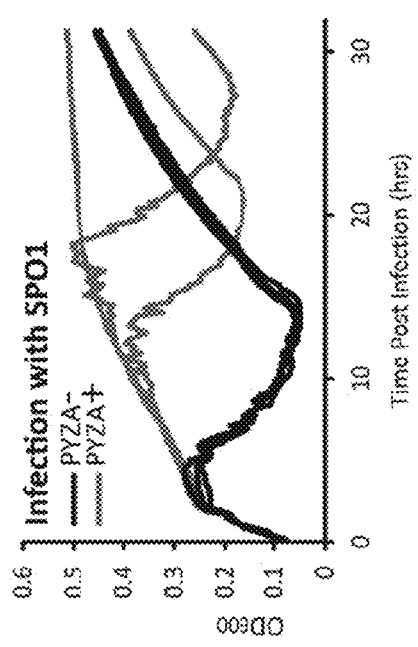

FIGS. 5A-B are bivariate graphs demonstrating culture dynamics in the control strain (BREX⁻, black) versus type 1 BREX-containing (red) strain of *Bacillus subtilis* BEST7003 cultures following infection with different phages, as evaluated by optical density measurements. FIGS. 5A-B depict culture dynamics over an extended period (>30 hours) following infection with SOP1 (FIG. 5A) and SP28G (FIG. 5B) demonstrating temporally reproducible culture decline of the control BREX strain, but irreproducible culture decline at stochastic time points of the type 1 BREX⁺ strain. Re-growth following culture crash represents phage-resistant mutants. Each curve in the graphs represents a single technical replicate.

Figure 6:
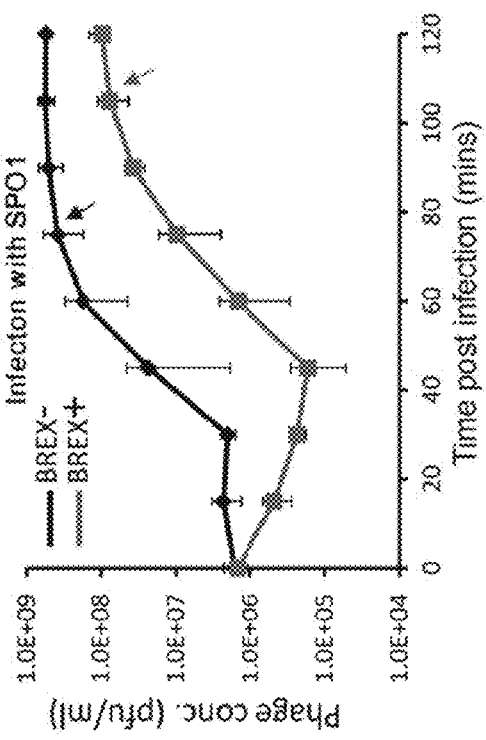

FIG. 6 is a bivariate graph demonstrating phage production during a one-step phage growth curve experiment with control strain (BREX⁻, black) versus type 1 BREX-containing (red) strain of Bacillus subtilis BEST7003 following infection with SPO1. The Y-axis represents absolute phage concentrations; the time points of maximal burst for BREX-lacking and BREX-containing strains are marked with black and red arrows, respectively. Error bars represent standard deviation of biological triplicates.

Figure 7:
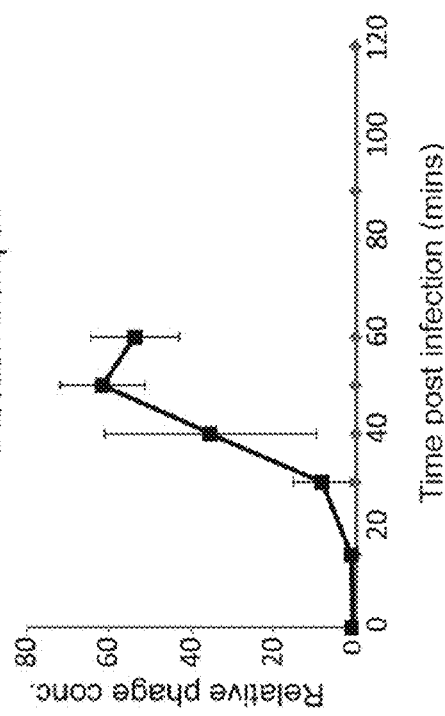

FIG. 7 demonstrates that BREX system confers resistance to phage first cycle of infection. Shown is a bivariate graph of phage production during a one-step phage growth curve experiment with control strain (BREX⁻, black) versus type 1 BREX-containing (red) strain of Bacillus subtilis BEST7003 infected with Φ3T. The Y-axis represents relative phage concentrations normalized to the value at the beginning of infection. Error bars represent standard deviation of biological triplicates.

Figure 8:
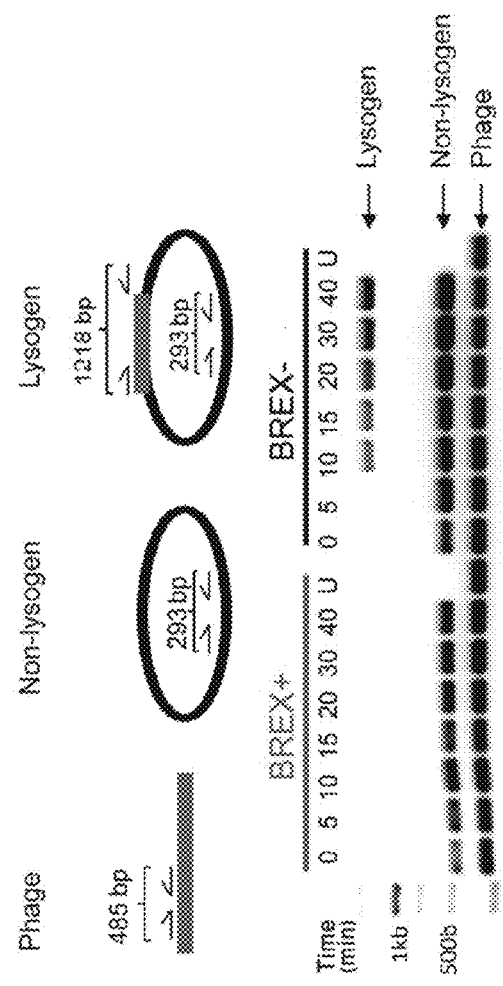

FIG. 8 is a representative PCR photograph showing the presence of lysogens during a phage infection time course in the control Bacillus subtilis strain (BREX⁻, black), but not in type 1 BREX-containing Bacillus subtilis strain (BREX⁺, red), or uninfected (U) strains. Amplicons for the bacterial DNA, phage DNA, and lysogen-specific DNA are 293 bp, 485 bp, and 1218 bp, respectively.

Figure 9:
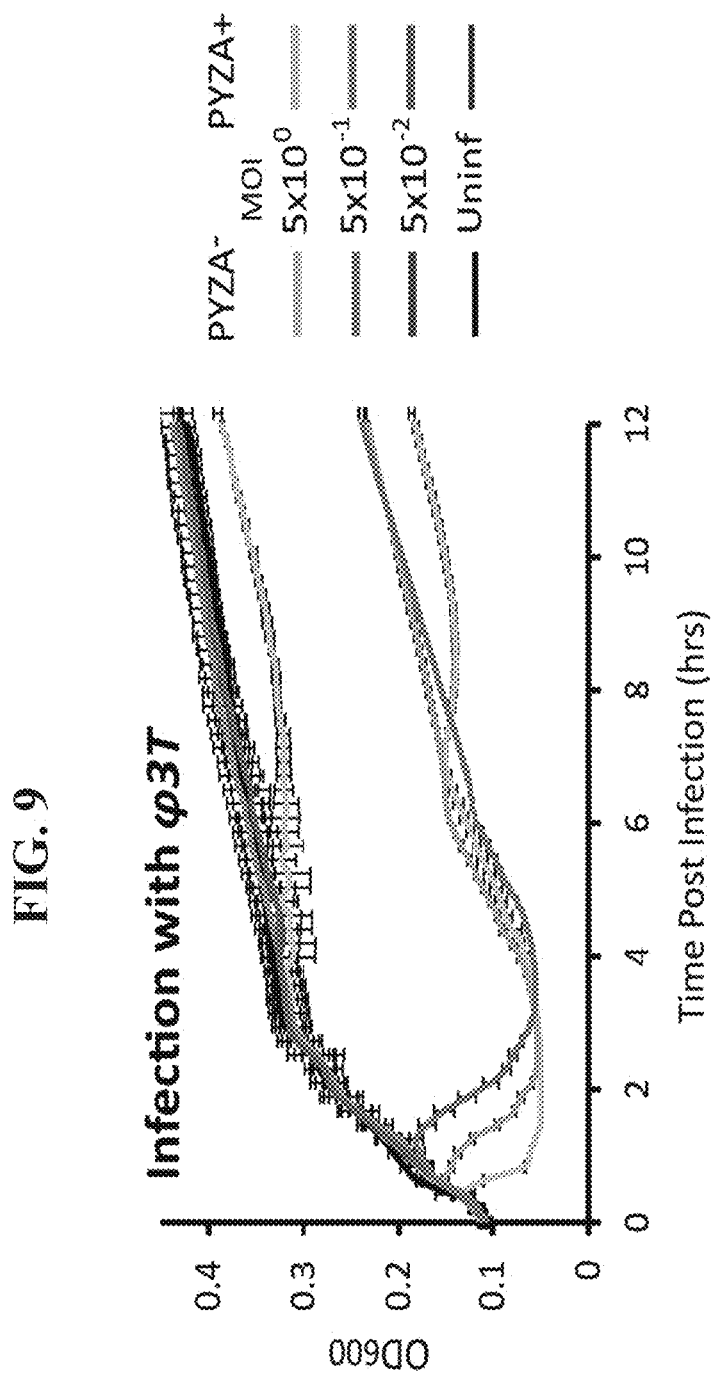

FIG. 9 is a bivariate graph demonstrating culture dynamics in the control strain (BREX⁻, black) versus type 1 BREX-containing (red) strain of Bacillus subtilis BEST7003 cultures following infection with increasing MOI of Φ3T phage showing that increasing the MOI shortens the time to culture crash for the BREX⁻ strain, but minimally influences the growth of the BREX⁺ strains. Error bars represent standard deviation of technical triplicates.

Figure 10:
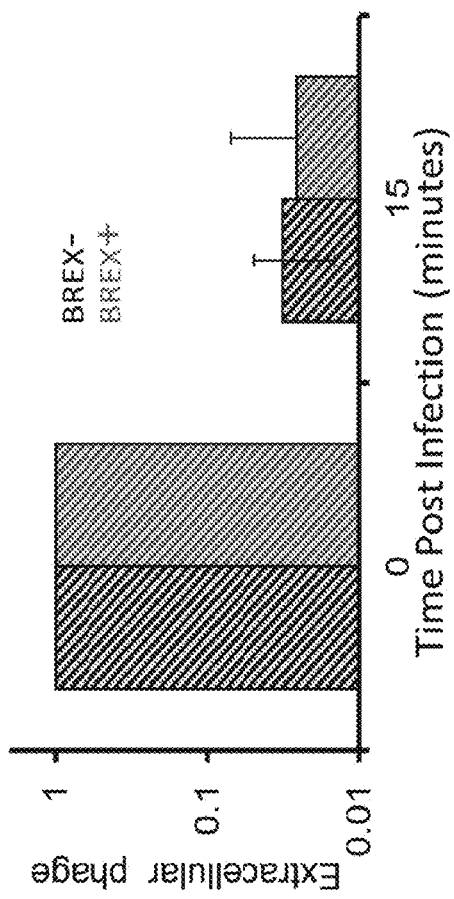

FIG. 10 is a bar graph representing the number of extracellular phages in the control strain (BREX⁻, black) versus type 1 BREX-containing (red) strain of Bacillus subtilis BEST7003 cultures 15 minutes following infection with phage Φ3T.

Figure 11:
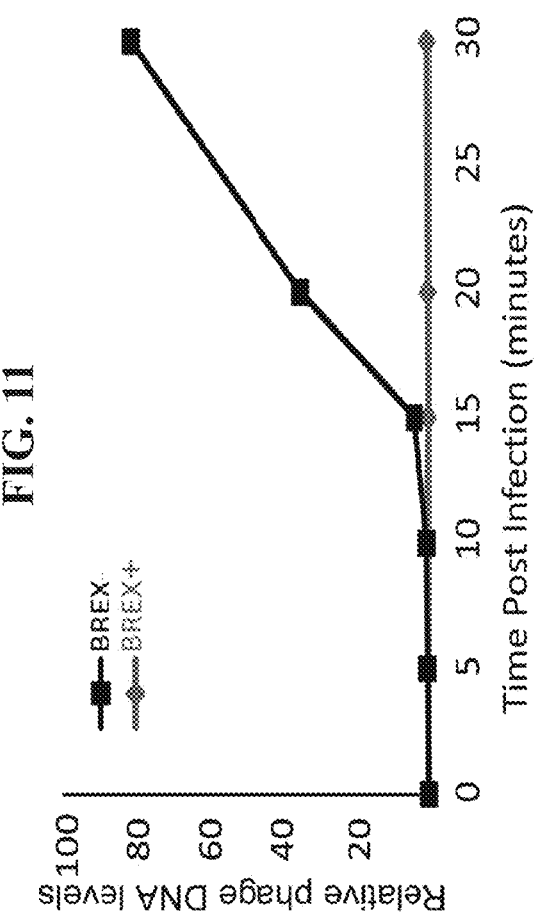

FIG. 11 is a bivariate graph illustrating that phage DNA replication is observed in control Bacillus subtilis BEST7003 strain (BREX, black) but does not occur in type 1 BREX-containing strain of Bacillus subtilis BEST7003 (BREX⁺, red). The Y-axis represents relative phage DNA concentration normalized to the value at the beginning of infection, as evaluated by Illumina sequencing of total cellular DNA.

FIG. 12 is a southern blot photograph demonstrating phage Φ3T genome at different time points following infection of control (BREX⁻, black) vs. type 1 BREX-containing (BREX⁺, red) Bacillus subtilis BEST7003 strains. Numbers marking each lane indicate the time (in minutes) following infection. U lanes indicate uninfected control.

FIGS. 13A-B demonstrate the methylation activity of BREX. FIG. 13A depicts the consensus sequence around the modified base in the type 1 BREX-containing Bacillus subtilis BEST7003 strain. The arrow marks the modified base. FIG. 13B is a table summarizing the statistics of the modified motifs in the type 1 BREX-containing Bacillus subtilis BEST7003 strain.

FIGS. 14A-B are bivariate graphs demonstrating culture dynamics of non-infected (FIG. 14A) or following infection with phage Φ3T (FIG. 14B) in the control strain (BREX⁻, black), type 1 BREX-containing (red) and type 1 BREX without pglX-containing (pglXΔ, green) strains of Bacillus subtilis BEST7003 cultures, as evaluated by optical density measurements.

FIG. 15 is a Common Tree of bacteria and archaea as represented in the NCBI Taxonomy resource demonstrating the Distribution of BREX systems across the phylogenetic tree of bacteria and archaea. Organisms in which a BREX system exists are colored following the BREX subtype color code from FIG. 1A. Extensive horizontal transfer is observed by the lack of coherence between the species tree and the pglZ phylogeny.

Figure 16:
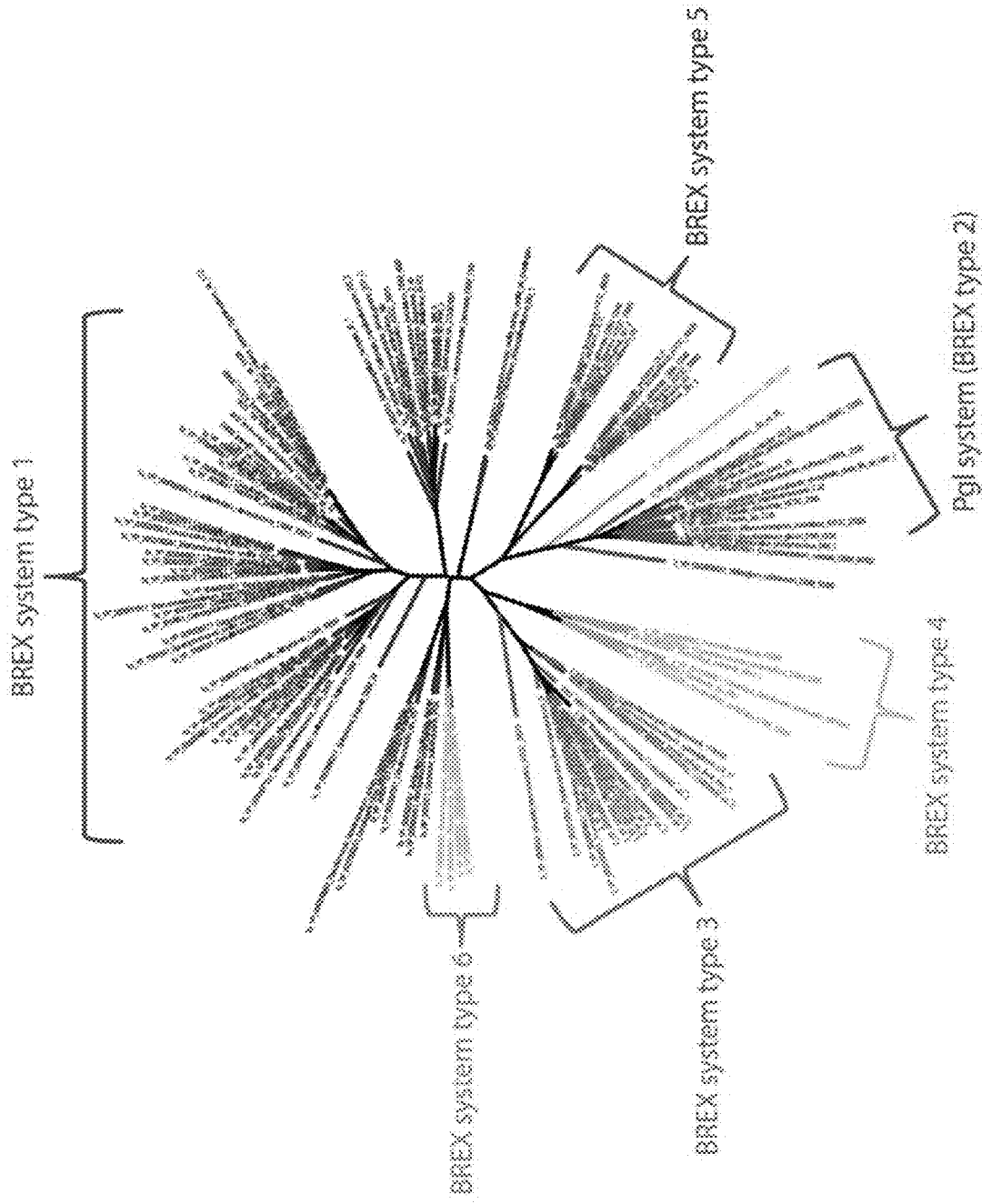

FIG. 16 is a phylogenetic tree representing brxC/pglY protein occurrences as determined by aligning only the P-loop domain showing that the brxC/pglY phylogeny follows the classification of BREX subtypes and co-evolves with pglZ. The tree is color coded according to the different BREX subtypes as in FIG. 1A. Only brxC/PglY proteins appearing in complete systems were taken for this analysis.

Figure 17C:
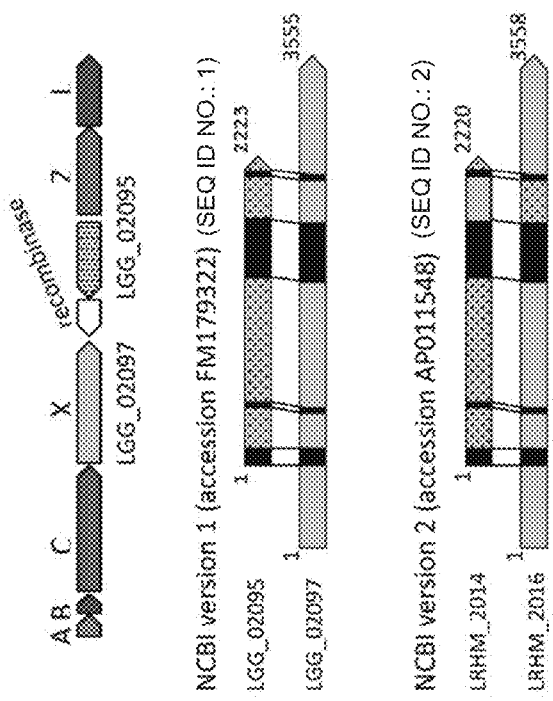
Figure 17A:
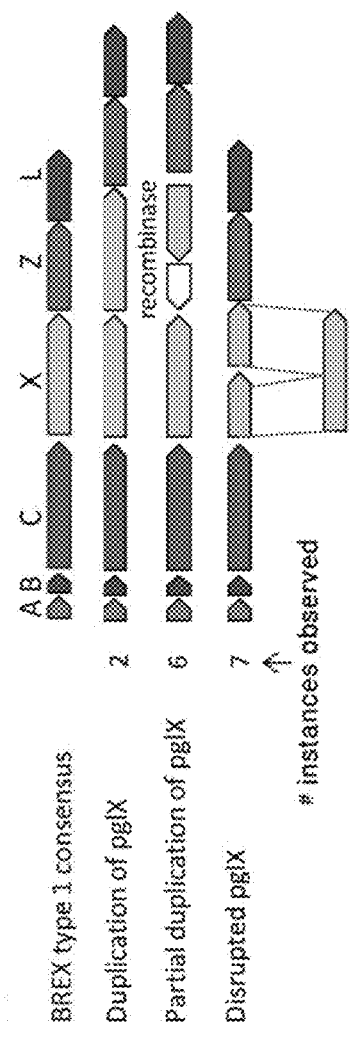
Figure 17B:
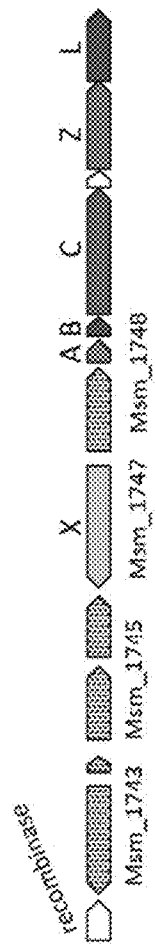

FIGS. 17A-C illustrate frequent irregularities in the adenine-specific methylase pglX in BREX type 1. FIG. 17A depicts irregular genotypes (duplication, inversion and premature stop codon) associated with pglX. FIG. 17B depicts genomic organization of BREX system type 1 in Methanobrevibacter smithii ATCC 35061 (NC_009515 SEQ ID NO: 6163). FIG. 17C depicts genomic organization of BREX system type 1 in Lactobacillus rhamnosus GG. A cassette switch between the short and the long forms of pglX is observed when the sequences of two isolates of Lactobacillus rhamnosus GG (accessions FM179322 (NC_013198 SEQ ID NO: 1) and AP011548 (NC_017482 SEQ ID NO: 2) respectively are compared. Repeat sequences between the short and long forms are in black.

Figure 18:
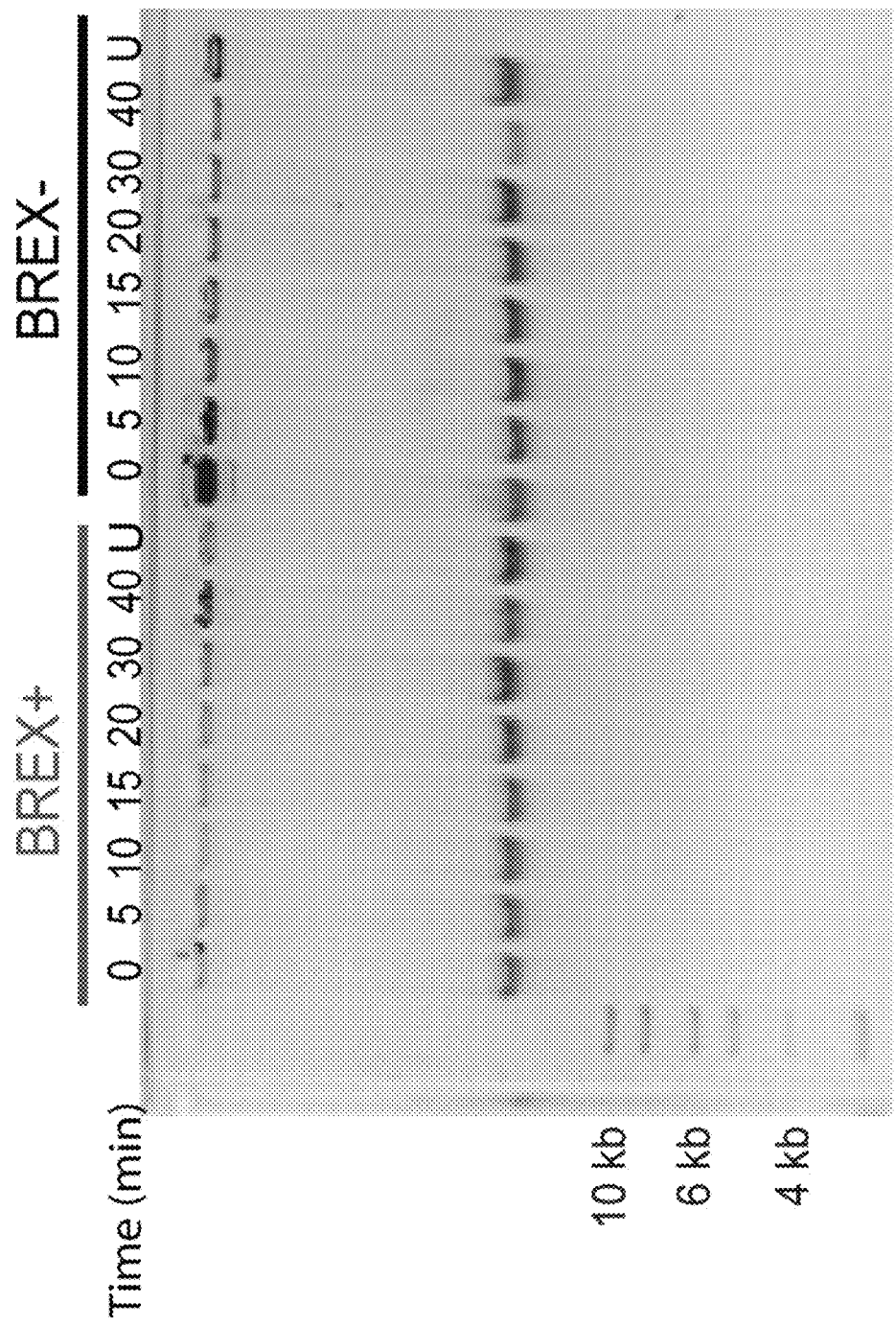

FIG. 18 is an agarose gel photograph of DNA extracted from type 1 BREX-containing and BREX-lacking strains of Bacillus subtilis BEST7003 cultures, following time course infection with phage Φ3T demonstrating no degradation of host DNA.

DESCRIPTION OF SPECIFIC EMBODIMENTS OF THE INVENTION

The present invention, in some embodiments thereof, relates to polynucleotides encoding BREX system polypeptides and methods of using same.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The continuous bacteria-phages arms race has led to rapid evolution of both anti-phage bacterial resistance systems and counter-resistance mechanisms developed by phages, many of which are yet uncharacterized. A broad array of food products, commodity chemicals, and biotechnology products are manufactured industrially by large-scale bacterial fermentation of various substrates. Development of defense strategies and systems to curtail the propagation and evolution of phages in fermentation vats is therefore warranted. On the counter arm, properly formulated and applied phages have sufficient potential to cure bacterial infections addressing the therapeutic need for new antibiotics.

The PGL system has previously been reported as conferring phage resistance manifested by attenuation of phage growth in the second cycle.

Whilst reducing the present invention to practice, the present inventors have now uncovered a novel multi-gene phage resistance system broadly distributed in bacteria and archaea, which the present inventors denoted BREX (Bacteriophage Elusion) system. The newly discovered BREX system shares some structural and functional similarities with the previously described PGL system. The abundance of this system and the efficiency in which it protects against phages implies that it plays an important role as a major line of defense encoded by bacteria against phages.

Specifically, the present inventors have uncovered that BREX system confers complete or partial resistance against phages spanning a wide phylogeny of phage types, including lytic and temperate (also referred lysogenic) phages, even in the first cycle of infection. Alternatively, mutations (e.g.; frame shift in pglX) affecting the functionality of the BREX system abrogate phage resistance.

Taken together, the present teachings suggest that BREX system and functional portions thereof can be used for conferring phage resistance. Such naturally and engineered bacteria can be utilized for example in the dairy industry, where phages cause serious annual losses, as well as in other industries that rely on large-scale bacterial fermentation for biotechnological production. Alternatively, anti-BREX system agents can be used as antibiotics.

As is illustrated hereinunder and in the examples section which follows, the present inventors have uncovered that BREX system confers complete or partial resistance against phages spanning a wide phylogeny of phage types, including lytic and temperate phages, even in the first cycle of infection. Even more so, mutations (e.g.; frame shift in pglX) affecting the functionality of the BREX system abrogate phage resistance. Specifically, the present inventors have shown that the BREX system exists in almost 10% of sequenced microbial genomes, and can be divided into six coherent subtypes containing 4-8 genes each, two of which are core genes, pglZ and brxC/pglY, present in all subtypes (Examples 1-2, Tables 1-8, FIGS. 1A-C). As detailed in Example 2 and Tables 2-7, in most cases, a single BREX system per organism was found, and in several of the identified systems, one of the genes was either missing or has become a pseudogene. The inventors have further demonstrated that the BREX system undergoes extensive horizontal transfer, with subtype 1, the most frequent subtype of this system, possibly the ancestral form of BREX (Example 5, FIGS. 1A-C, 16.)

The inventors have further demonstrated (Examples 3 and 4, FIGS. 4A-M, 5A-B, 6, 7 and Table 9) that integration of the BREX type 1 system into *Bacillus subtilis* strain lacking an endogenous BREX system confers complete protection from infection by the temperate SPβ, SP16, Zeta, Φ3T, and SPO2 phages and partial protection from infection by the lytic SP82G and SPO1 phages, even in the first cycle of infection.

The present inventors have gained insight into BREX mechanism of action (Example 4, FIGS. 8-12), accordingly it is demonstrated that integration of the type 1 BREX system into *Bacillus subtilis* strain allows phage adsorption but prevents phage lysogeny and phage DNA replication. In addition, the system methylates the host chromosomal DNA at a specific motif while sparing the phage DNA and this methylation is likely to be essential for the system's activity. Specifically, the methylase gene pglX was essential for the function of the type 1 BREX system and presented high rates of irregularities (Example 4. FIGS. 13A-B and 14A-B and Example 6. FIGS. 17A-B), thus marking pglX as possibly undergoing frequent phase-variation, and suggesting that this gene might confer specificity in the BREX system, or, alternatively, is particularly toxic. The data strongly indicates that the system does not an act via the previously described PGL mechanism or via abortive infection (Abi) or simple restriction/modification mechanisms.

Consequently, the present invention provides methods and compositions for use in the food, feed, medical and veterinary industries to confer phage resistance. On the other hand, the present invention provides methods suitable for use in the food, feed, medical and veterinary industries to generate phage with broader host range that can be used for more effective bio-control of bacteria.

Thus, according to a first aspect of the present invention, there is provided an isolated polynucleotide encoding a BREX system comprising a nucleic acid sequence encoding the BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW, and wherein the BREX system confers phage resistance to a bacteria recombinantly expressing same.

According to a second aspect of the present invention, there is provided an isolated polynucleotide encoding a BREX system comprising a nucleic acid sequence encoding the BREX system comprising brxC/pglY, pglZ, pglX, pglW and at least one of brxD and brxHI, and wherein the BREX system confers phage resistance to a bacteria recombinantly expressing same.

According to another aspect of the present invention, there is provided an isolated polynucleotide comprising a nucleic acid sequence encoding a BREX system comprising:
(i) brxA, brxB, brxC/pglY, pglX, pglZ and brxL;
(ii) brxA, brxB, (brxC/pglY)$_{x2}$, pglX, pglZ and brxHII;
(iii) brxE, brxA, brxB, brxC/pglY, pglX, pglZ, brxD and brxHI;
(iv) brxF, brxC/pglY, pglXI, brxHII, pglZ and brxA;
(v) pglW, pglX, brxC/pglY, pglZ, brxD and brxHII; or
(vi) brxP, brxC/pglY, pglZ and brxL As used herein the term "isolated" refers to at least partially separated from the natural environment, physiological environment e.g., a microorganism e.g., bacteria.

As used herein "BREX system" (previously denoted "PYZA system") or a "functional BREX system", refers to a multi-gene system which comprises BRX and/or PGL genes which expression confers phage resistance.

According to specific embodiments, the BREX system is characterized by at least one of
(i) not being an abortive infection system;
(ii) not being a restriction modification system;
(iii) not preventing phage adsorption to a bacteria expressing same.

The BREX system may be characterized by one, two or all i.e.: (i); (ii); (iii); (i)+(ii); (i)+(iii); (ii)+(iii) and (i)+(ii)+(iii).

According to a specific embodiment the BREX system is characterized by (i)+(ii)+(iii).

As used herein "abortive infection (Abi) system" refers to a controlled cell death of an infected bacterial cell which takes place prior to the production of phage progeny, thus protecting the culture from phage propagation. Methods of analyzing Abi include, but are not limited to cell survival assays using high multiplicity of infection, one step growth assays and determination of phage DNA replication by e.g. DNA sequencing and southern blot analysis as further described hereinbelow.

As used herein "restriction modification system" refers to the recognition and cleavage of foreign DNA. Typically, a restriction modification system comprises a restriction enzyme having an activity of cleaving DNA and a modification enzyme capable of protecting host DNA from the cleavage by the restriction enzyme e.g. by methylating the host DNA. Analyzing restriction modification mode of action include, but is not limited to, evaluation of host specific methylation, presence of degraded foreign DNA and host cell death in the absence of the modification enzyme by methods described infra.

As used herein "adsorption" refers to the attachment to the host (e.g. bacteria) cell surface via plasma membrane proteins and glycoproteins. Methods of analyzing phage adsorption include, but are not limited to enumerating free phages in bacterial cultures infected with the phages immediately after phage addition and at early time points (e.g. 30 minutes) following phage addition as further described hereinbelow.

As used herein "phage resistance" refers to a phage infection resistance which can be a first or a second cycle resistance. The phage can be a lytic phage or a temperate (lysogenic) phage. According to a specific embodiment the BREX system confers phage resistance to a first cycle phage infection. According to yet other specific embodiments, BREX system confers resistance to lytic phages.

According to a specific embodiment, BREX system confers resistance to phage lysogeny.

As used herein, the term "lysogeny" refers to the incorporation of the phage genetic material inside the genome of the host (e.g. bacteria). Methods of analyzing phage lysogent are well known in the art and include, but not limited to, DNA sequencing and PCR analysis.

According to another specific embodiment, BREX system confers resistance to phage DNA replication.

According to specific embodiments. BREX system does not confer resistance to phages Φ105, rho10 and rho14.

As used herein, "phage resistance" refers to an increase of at least 10% in bacterial resistance towards a phage in comparison to bacteria of the same species under the same developmental stage (culture state) which does not express a BREX system, as may be manifested in e.g. bacterial viability, phage lysogeny and phage DNA replication. According to a specific embodiment, the increase is in at least 20%, 30%, 40% or even higher say, 50%, 60%, 70%, 80%, 90% or more than 100%.

Assays for testing phage resistance are well known in the art and mentioned hereinbelow.

According to specific embodiments, BREX system confers resistance to a plasmid. The plasmid may undergo integration into the bacterial genome or may be episomal.

According to a specific embodiment, the plasmid is episomal.

As used herein, "plasmid resistance" refers to an increase of at least 5% in bacterial resistance towards a plasmid in comparison to bacteria of the same species under the same developmental stage (culture state) which does not express a BREX system, as may be manifested in e.g. viability. According to a specific embodiment, the increase is in at least 10%, 20%, 30%, 40% or even higher say, 50%, 60%, 70%, 80%, 90% or more than 100%.

Assays for testing plasmid resistance are well known in the art and include, but not limited to, a transformation assay such as described in Itaya and Tsuge [Methods Enzymol (2011) 498:427-47].

As used herein, "expressing" or "expression" refers to gene expression at the RNA and/or protein level.

As used herein the "Phage growth Limitation" abbreviated as PGL refers to a cluster of genes which were previously described in *Streptomyces coelicolor* A3(2) (Chinenova T. A. et al, 1982; Sumby, P. & Smith, M. C. 2002, herein incorporated by reference in its entirety).

As used herein the "Bacteriophage Exclusion" abbreviated as BREX refers to a cluster of genes some of which were previously described in *Streptomyces coelicolor* A3(2) (Chinenova T. A. et al, 1982; Sumby, P. & Smith, M. C. 2002,).

According to specific embodiments, the BREX genes which compose the BREX system comprise brxC/pglY, pglZ pglW, pglX, pglXI, brxP, brxHI, brxHII, brxL, brxD, brxA, brxB, brxF, and brxE, which can be divided into six coherent subtypes comprising 4-8 genes each, in which the gene order and composition is conserved.

Thus, the BREX subtypes according to some embodiments of the present invention are selected from the group consisting of:

(1) brxC/pglY, pglZ and at least one of pglX, pglXI, brxP, brxHI, brxHII, brxL, brxD, brxA, brxB, brxF, and brxE, with the proviso that the functional BREX system does not comprise pglW.

(2) brxC/pglY, pglZ, pglX, pglW and at least one of brxD and brxHI, (3i) brxA, brxB, brxC/pglY, pglX, pglZ and brxL (also may be referred to as Type 1).

(3ii) brxA, brxB, (brxC/pglY)$_{x2}$, pglX, pglZ and brxHII (also may be referred to as Type 5), (3iii) brxE, brxA, brxB, brxC/pglY, pglX, pglZ, brxD and brxHI (also may be referred to as Type 6), (3iv) brxF, brxC/pglY, pglXI, brxHII, pglZ and brxA (also may be referred to as Type 3), (3v) pglW, pglX, brxC/pglY, pglZ, brxD and brxHI (also may be referred to as Type 2), or (3vi) brxP, brxC/pglY, pglZ and brxL (also may be referred to as Type 4).

Thus, specific examples of BREX systems which can be used according to the present teachings include but are not limited to BREX system type 1, BREX system type 2, BREX system type 3. BREX system type 4, BREX system type 5 and BREX system type 6 (see FIG. 1A).

According to specific embodiments, BREX system type 1 (previously denoted PYZA system type 1a) comprises brxA, brxB, brxC/pglY, pglX, pglZ and brxL; BREX system type 5 (previously denoted PYZA system type 1b) comprises brxA, brxB, (brxC/pglY)$_{x2}$, pglX, pglZ and brxHII; BREX system type 6 (previously denoted PYZA system type 1c) comprises brxE, brxA, brxB, brxC/pglY, pglX, pglZ, brxD and brxHI; BREX system type 3 (previously denoted PYZA system type 2) comprises brxF, brxC/pglY, pglXI, brxHII, pglZ and brxA; BREX system type 2 (previously denoted PYZA system type 3) comprises pglW, pglX, brxC/pglY, pglZ, brxD and brxHI; and BREX system type 4 (previously denoted PYZA system type 4) comprises brxP, brxC/pglY, pglZ and brxL.

According to specific embodiments the BREX system is type 1 comprising brxA, brxB, brxC/pglY, pglX, pglZ and brxL.

Two of the six genes found in type 1 BREX conserved cluster share homology with genes from the previously reported PGL system[10,11]: pglZ, coding for a protein with a predicted alkaline phosphatase domain, and pglX, coding for a protein with a putative methylase domain. The four additional genes include (i) a Ion-like protease-domain gene, denoted herein as brxL; (ii) brxA; (iii) brxB; and (iv) a ~1200 amino acid protein with an ATP binding motif (GXXXXGK[T/S]), denoted herein as brxC. The preferential localization of this conserved gene cluster in the genomic vicinity of other defense genes suggests that it is a novel phage defense system.

The phage defense system originally described in *Streptomyces coelicolor* A3(2) as PGL is defined according to the present teachings as a type 2 BREX. While the PGL was described to be composed of four genes, pglW, pglX, pglY and pglZ, the present teaching suggest that 2 more genes, brxD and brxHI, are an integral part of the type 2 BREX system. In addition, pglW, an integral part of the previously described PGL, exists exclusively in type 2 BREX subtype.

The major phage resistance systems that were characterized to date, including the restriction-modification and CRISPR-Cas systems, encode mostly for proteins that interact with and manipulate DNA and RNA molecules. While the BREX system contains such proteins including methylases and helicases it also contains genes coding for proteins predicted to be involved in the manipulation of other proteins, such as the Ion-like protease, brxL, the predicted alkaline phosphatase, pglZ, and the serine/threonine kinase, brxW. Thus, according to specific embodiments, the defense mechanism employed by the BREX system takes place later in the infection where phage proteins are already produced and can be manipulated by pglZ and/or brxL.

According to other specific embodiments, BREX proteins target phage proteins co-injected with the phage DNA early in the infection cycle.

According to specific embodiments the BREX system acts before phage DNA replication.

According to specific embodiments, BREX proteins interact with other bacterial-encoded proteins to regulate BREX activity.

As used herein, the terms "pglY", "brxC" and "brxC/pglY" refer to the polynucleotide and expression product e.g., polypeptide of the PGLY or BRXC gene. The polypeptide product of the PGLY and BRXC genes typically contains p-loop ATPase/ATP binding domain DUF2791 (pfam10923, SEQ ID NO: 6162) and a DUF499 domain. brxC/pglY together with pglZ and at least one of pglX, pglXI, brxP, brxHI, brxHII, brxL, brxD, brxA, brxB, brxF, brxE, and pglW, comprise a BREX system.

According to specific embodiments, brxC/pglY is selected from the group consisting of SEQ ID NO: 3155, 157-765 and 767-1175.

As used herein, the term "pglZ" refers to the polynucleotide and expression product e.g., polypeptide of the PGLZ gene. The polypeptide product of the PGLZ gene typically contains an alkaline phosphatase domain pfam08665. pglZ together with brxC/pglY and at least one of pglX, pglXI, brxP, brxHI, brxHII, brxL, brxD, brxA, brxB, brxF, brxE, and pglW, comprise a BREX system.

According to specific embodiments pglZ is selected from the group consisting of SEQ ID NO: 1176-1318, 1320-1856, 1858-2250, 6205 and 6204.

As used herein, the term "pglX" refers to the polynucleotide and expression product e.g., polypeptide of the PGLX gene. The polypeptide product of the PGLX gene typically contains an adenine-specific DNA methyltransferase domain pfam13659 (COG1002/COG0286). pglX together with at least brxC/pglY and pglZ and optionally at least one of pglXI, brxP, brxHI, brxHII, brxL, brxD, brxA, brxB, brxF, brxE and pglW, comprise a BREX system. pglX is a critical gene as the present inventors have shown that it presented high rates of irregularities in the BREX systems documented and a frame shift mutation in this gene in one of the type 1 BREX-containing *Bacillus subtilis* strains obtained was not active against any of the tested phages. In addition, *Bacillus subtilis* strains containing a type 1 BREX having a deletion of pglX were sensitive to all the phages tested.

According to specific embodiments pglX is selected from the group consisting of SEQ ID NO: 2251-3280 and 6186-6201.

According to specific embodiments, pglX is a methylase.

According to a specific embodiment, the pglX methylase and pglXI methylase are analogous in BREX systems types 1 and 3, respectively.

According to specific embodiments, the methylase of the BREX system methylates the bacterial DNA.

According to a specific embodiment, the methylase of the BREX system drives motif-specific (e.g. an adenine residue in TAGGAG motif) methylation on the genomic DNA of a bacteria expressing same. According to specific embodiments the methylation is non-polindromic. According to specific embodiments the BREX system methylase does not methylate a phage genome.

According to specific embodiments the methylation serves as part of the self/non-self recognition machinery of BREX.

According to a specific embodiment, type 4 BREX does not contain a methylase.

According to a specific embodiment the pglX methylase and brxP reductase are analogous in BREX systems types 1 and 4, respectively.

Methods of assessing DNA methylation and, more specifically, adenine-specific methylation are well known in the art and include e.g. the PacBio sequencing platform [Murray et al. Nucleic acids research (2012) 40: 11450-11462].

As used herein, the term "pglXI" refers to the polynucleotide and expression product e.g., polypeptide of the PGLXI gene. The polypeptide product of the PGLXI gene typically contains an adenine-specific DNA methylase COG0863/COG1743 (pfam 01555). pglXI together with at least brxC/pglY and pglZ and optionally at least one of pglX, brxP, brxHI, brxHII, brxL, brxD, brxA, brxB, brxF, brxE and pglW, comprise a BREX system.

According to specific embodiments pglXI is selected from the group consisting of SEQ ID NO: 3281-3296, 3298-3356 and 3358-3403.

As used herein, the term "brxP" (previously denoted "pglPA") refers to the polynucleotide and expression product e.g., polypeptide of the BRXP gene. The polypeptide product of the BRXP gene typically contains a phosphoadenosine phosphosulfate reductase domain COG0175 (pfam01507), and a pfam13182 domain. brxP together with at least brxC/pglY and pglZ and optionally at least one of pglX, pglXI, brxHI, brxHII, brxL, brxD, brxA, brxB, brxF, brxE and pglW, comprise a BREX system.

According to specific embodiments brxP is selected from the group consisting of SEQ ID NO: 3404-3440.

As used herein, the term "brxHI" (previously denoted "pglHI") refers to the polynucleotide and expression product e.g., polypeptide of the BRXHI gene. The polypeptide product of the BRXHI gene typically contains an Lhr-like a helicase domain COG1201. brxHI together with at least brxC/pglY and pglZ and optionally at least one of pglX, pglXI, brxP, brxHII, brxL, brxD, brxA, brxB, brxF, brxE and pglW, comprise a BREX system.

According to specific embodiments brxHI is selected from the group consisting of SEQ ID NO: 3543-3642.

As used herein, the term "brxHII" (previously denoted "pglHII") refers to the polynucleotide and expression product e.g., polypeptide of the BRXHII gene. The polypeptide product of the BRXHII gene typically contains a DNA/RNA helicase domain COG0553. brxHII together with at least brxC/pglY and pglZ and optionally at least one of pglX, pglXI, brxP, brxHI, brxL, brxD, brxA, brxB, brxF, brxE and pglW, comprise a BREX system.

According to specific embodiments brxHII is selected from the group consisting of SEQ ID NO: 3441-3460, 3462-3511, 3513-3542 and 6173-6185.

As used herein, the term "brxL" (previously denoted "pglL") refers to the polynucleotide and expression product e.g., polypeptide of the BRXL gene. The polypeptide product of the BRXL gene typically contains a ion-like protease domain COG4930. brxL together with at least brxC/pglY and pglZ and optionally at least one of pglX, pglXI, brxP, brxHI, brxHII, brxD, brxA, brxB, brxF, brxE and pglW, comprise a BREX system.

According to specific embodiments brxL is selected from the group consisting of SEQ ID NO: 3643-4412, 6165, 6166, 6169, 6170, 6202 and 6203.

As used herein, the term "brxD" (previously denoted "pglD") refers to the polynucleotide and expression product e.g., polypeptide of the BRXD gene. The polypeptide product of the BRXD gene typically contains an ATP binding domain DUF2791 (pfam10923). brxD together with at least brxC/pglY and pglZ and optionally at least one of pglX, pglXI, brxP, brxHI, brxHII, brxL brxA, brxB, brxF, brxE and pglW, comprise a BREX system.

According to specific embodiments brxD is selected from the group of consisting SEQ ID NO: 4413-4488.

As used herein, the term "brxA" (previously denoted "pglA") refers to the polynucleotide and expression product e.g., polypeptide of the BRXA gene. The polypeptide product of the BRXA gene typically contains a DUF1819 (pfam08849) domain. The brxA protein displays significant structural homology to NusB spanning the RNA-binding interface, as well as part of the protein:protein interaction interface of NusB with NusE. In light of this similarity, according to specific embodiments brxA is an RNA binding protein. According to specific embodiments, brxA has a role in interfering with the phage infection cycle by disrupting anti-termination events essential for the phage cycle. brxA together with at least brxC/pglY and pglZ and optionally at least one of pglX, pglXI, brxP, brxHI, brxHII, brxL, brxD, brxB, brxF, brxE and pglW comprise a BREX system.

According to specific embodiments brxA is selected from the group consisting of SEQ ID NO: 4489-4621, 4623-5086, 5088-5415, 6167, 6168, 6171 and 6172.

As used herein, the term "brxB" (previously denoted "pglB") refers to the polynucleotide and expression product e.g., polypeptide of the BRXB gene. The polypeptide product of the BRXB gene typically contains a DUF1788 (pfam08747) domain. brxB together with at least brxC/pglY and pglZ and optionally at least one of pglX, pglXI, brxP. brxHI, brxHII, brxL, brxD, brxA, brxF, brxE and pglW, comprise a BREX system.

According to specific embodiments brxB is selected from the group consisting of SEQ ID NO: 5416-5947 and 6206-6209.

As used herein, the term "brxF" (previously denoted "pglC") refers to the polynucleotide and expression product e.g., polypeptide of the BRXF gene. The polypeptide product of the BRXF gene typically contains an ATPase domain, brxF together with at least brxC/pglY and pglZ and optionally at least one of pglX, pglXI, brxP, brxHI, brxHII, brxL, brxD, brxA, brxB, brxE and pglW, comprise a BREX system.

According to specific embodiments brxF is selected from the group consisting of SEQ ID NO: 5948-5957, 5959-5988 and 5990-6028.

As used herein, the term "brxE" (previously denoted "pglE") refers to the polynucleotide and expression product e.g., polypeptide of the BRXE gene. brxE together with at least brxC/pglY and pglZ and optionally at least one of pglX, pglXI, brxP, brxHI, brxHII, brxL, brxD, brxA, brxB, brxF, and pglW, comprise a BREX system.

According to specific embodiments brxE is selected from the group consisting of SEQ ID NO: 6029-6040.

As used herein, the term "pglW" refers to the polynucleotide and expression product e.g., polypeptide of the PGLW gene. The polypeptide product of the PGLW gene typically contains a serine/threonine kinase domain COG0515. pglW together with brxC/pglY, pglZ and pglX, and at least one of brxD and brxHI, and optionally at least one of pglXI, brxP, brxHII, brxL, brxA, brxB, brxF, and brxE, comprise a BREX system.

According to specific embodiments pglW is selected from the group consisting of SEQ ID NO: 6041-6138.

The terms "brxC/pglY", "pglZ", "pglX", "pglXI", "brxP", "brxHI", "brxHII", "brxL", "brxD", "brxA", "brxB", "brxF", "brxE", and "pglW" also refers to functional brxC/pglY, pglZ, pglX, pglXI, brxP, brxHI, brxHII, brxL, brxD, brxA, brxB, brxF, brxE, and pglW homologues which exhibit the desired activity (i.e., conferring phage resistance). Such homologues can be, for example, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% or 100% identical or homologous to the polypeptide SEQ ID NO: 614-765, 767-1175, 1714-1856, 1858-2250, 6204, 2766-3280, 6186, 6188, 6190, 6192, 6194, 6196, 6198, 6200, 3343-3356, 3358-3403, 3422-3440, 3492-3511, 3513-3542, 6173, 6175, 6178, 6180, 6182, 6184, 3593-3642, 4028-4412, 6165, 6169, 6202, 4438-4488, 4953-5086, 5088-5415, 6167, 6171, 5570-5947, 6206, 6208, 5979-5988, 5990-6028, 6035-6040 and 6090-6138, respectively, or 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99% or 100% identical to the polynucleotide sequence encoding same (as further described hereinbelow). The homolog may also refer to an ortholog, a deletion, insertion, or substitution variant, including an amino acid substitution.

Alternatively or additionally, homology can be based on shared motifs [e.g., the p-loop motif GXXXXGK(T/S) (DUF2791, SEQ ID NO: 6162) and DUF499 motifs present in pglY] combined with the conserved size of the gene in the different subtypes and the location of the gene in the gene cluster.

Sequence identity or homology can be determined using any protein or nucleic acid sequence alignment algorithm such as Blast, ClustalW, MUSCLE, and HHpred.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

According to specific embodiments the polynucleotides of the present invention are part of a nucleic acid construct comprising the polynucleotide encoding the BREX system and at least one cis-acting regulatory element for directing expression of the nucleic acid sequence.

Teachings of the invention further contemplate that the polynucleotides are part of a nucleic acid construct system where the BREX genes are expressed from a plurality of constructs.

Thus, the present invention further provides for a nucleic acid construct system comprising at least two nucleic acid constructs expressing a BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW.

The present invention further provides for a nucleic acid construct system comprising at least two nucleic acid constructs expressing a BREX system comprising brxC/pglY, pglZ, pglX, pglW and at least one of brxD and brxHI.

Thus according to specific embodiments, the nucleic acid construct system comprises an individual nucleic acid construct for each BREX system pgl and/or brx gene.

According to other specific embodiments a single construct comprises a number of BREX system pgl and/or brx genes.

Cis acting regulatory sequences include those that direct constitutive expression of a nucleotide sequence as well as those that direct inducible expression of the nucleotide sequence only under certain conditions.

According to specific embodiments, the nucleic acid construct includes a promoter sequence for directing transcription of the polynucleotide sequence in the cell in a constitutive or inducible manner.

Constitutive promoters suitable for use with some embodiments of the invention are promoter sequences which are active under most environmental conditions and most types of cells such as the cytomegalovirus (CMV) and Rous sarcoma virus (RSV). Inducible promoters suitable for use with some embodiments of the invention include for example the tetracycline-inducible promoter (Zabala M. et al., Cancer Res. 2004, 64(8): 2799-804) or pathogen-inducible promoters. Such promoters include those from pathogenesis-related proteins (PR proteins), which are induced following infection by a pathogen.

According to specific embodiments the promoter is a bacterial nucleic acid (e.g., expression) construct.

A bacterial promoter is any DNA sequence capable of binding bacterial RNA polymerase and initiating the downstream (3') transcription of a coding sequence into mRNA. A promoter can have a transcription initiation region, which is usually placed proximal to the 5' end of the coding sequence. This transcription initiation region typically includes an RNA polymerase binding site and a transcription initiation site. A bacterial promoter can also have a second domain called an operator, which can overlap an adjacent RNA polymerase binding site at which RNA synthesis begins. The operator permits negative regulated (inducible) transcription, as a gene repressor protein can bind the operator and thereby inhibit transcription of a specific gene. Constitutive expression can occur in the absence of negative regulatory elements, such as the operator. In addition, positive regulation can be achieved by a gene activator protein binding sequence, which, if present is usually proximal (5') to the RNA polymerase binding sequence.

An example of a gene activator protein is the catabolite activator protein (CAP), which helps initiate transcription of the lac operon in *Escherichia coli* (Raibaud et al. (1984) Annu. Rev. Genet. 18:173). Regulated expression can therefore be either positive or negative, thereby either enhancing or reducing transcription. Other examples of positive and negative regulatory elements are well known in the art. Various promoters that can be included in the protein expression system include, but are not limited to, a T7/LacO hybrid promoter, a trp promoter, a T7 promoter, a lac promoter, and a bacteriophage lambda promoter. Any suitable promoter can be used to carry out the present invention, including the native promoter or a heterologous promoter. Heterologous promoters can be constitutively active or inducible. A non-limiting example of a heterologous promoter is given in U.S. Pat. No. 6,242,194 to Kullen and Klaenhammer.

Sequences encoding metabolic pathway enzymes provide particularly useful promoter sequences. Examples include promoter sequences derived from sugar metabolizing enzymes, such as galactose, lactose (lac) (Chang et al. (1987) Nature 198:1056), and maltose. Additional examples include promoter sequences derived from biosynthetic enzymes such as tryptophan (trp) (Goeddel et al. (1980) Nucleic Acids Res. 8:4057; Yelverton et al. (1981) Nucleic Acids Res. 9:731; U.S. Pat. No. 4,738,921; EPO Publication Nos. 36.776 and 121.775). The beta-lactamase (bla) promoter system (Weissmann, (1981) "The Cloning of Interferon and Other Mistakes," in Interferon 3 (ed. 1. Gresser); bacteriophage lambda PL (Shimatake et al. (1981) Nature 292:128); the arabinose-inducible araB promoter (U.S. Pat. No. 5,028,530); and T5 (U.S. Pat. No. 4,689,406) promoter systems also provide useful promoter sequences. See also Balbas (2001) Mol. Biotech. 19:251-267, where *E. coli* expression systems are discussed.

In addition, synthetic promoters that do not occur in nature also function as bacterial promoters. For example, transcription activation sequences of one bacterial or phage promoter can be joined with the operon sequences of another bacterial or phage promoter, creating a synthetic hybrid promoter (U.S. Pat. No. 4,551,433). For example, the tac (Amann et al. (1983) Gene 25:167; de Boer et al. (1983) Proc. Natl. Acad. Sci. 80:21) and trc (Brosius et al. (1985) J. Biol. Chem. 260:3539-3541) promoters are hybrid trp-lac promoters comprised of both trp promoter and lac operon sequences that are regulated by the lac repressor. The tac promoter has the additional feature of being an inducible regulatory sequence. Thus, for example, expression of a coding sequence operably linked to the tac promoter can be induced in a cell culture by adding isopropyl-1-thio-.beta.-D-galactoside (IPTG). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The phage T7 RNA polymerase/promoter system is an example of a coupled promoter system (Studier et al. (1986) J. Mol. Biol. 189:113; Tabor et al. (1985) Proc. Natl. Acad. Sci. 82:1074). In addition, a hybrid promoter can also be comprised of a phage promoter and an *E. coli* operator region (EPO Publication No. 267,851).

The nucleic acid construct can additionally contain a nucleotide sequence encoding the repressor (or inducer) for that promoter. For example, an inducible vector of the present invention can regulate transcription from the Lac operator (LacO) by expressing the nucleotide sequence encoding the LacI repressor protein. Other examples include the use of the lexA gene to regulate expression of pRecA, and the use of trpO to regulate ptrp. Alleles of such genes that increase the extent of repression (e.g., lacIq) or that modify the manner of induction (e.g., lambda C1857, rendering lambda pL thermo-inducible, or lambda CI+, rendering lambda pL chemo-inducible) can be employed.

Various construct schemes can be utilized to express few genes from a single nucleic acid construct. For example, the genes can be co-transcribed as a polycistronic message from a single promoter sequence of the nucleic acid construct. To enable co-translation of all the genes from a single polycistronic message, the different polynucleotide segments can be transcriptionally fused via a linker sequence including an internal ribosome entry site (IRES) sequence which enables the translation of the polynucleotide segment downstream of the IRES sequence. In this case, a transcribed polycistronic RNA molecule including the coding sequences of all the genes will be translated from both the capped 5' end and the internal IRES sequence of the polycistronic RNA molecule to thereby produce the whole BREX system.

Alternatively, each two polynucleotide segments can be translationally fused via a protease recognition site cleavable by a protease expressed by the cell to be transformed with the nucleic acid construct. In this case, a chimeric polypeptide translated will be cleaved by the cell expressed protease to thereby generate the whole BREX system.

Still alternatively, the nucleic acid construct of some embodiments of the invention can include at least two promoter sequences each being for separately expressing a specific pgl or brx. These at least two promoters which can be identical or distinct can be constitutive, tissue specific or regulatable (e.g. inducible) promoters functional in one or more cell types.

The nucleic acid construct (also referred to herein as an "expression vector" or a "vector") of some embodiments of the invention includes additional sequences which render this vector suitable for replication and integration in prokaryotes, eukaryotes, or preferably both (e.g., shuttle vectors). In addition, typical vectors may also contain a transcription and translation initiation sequence, transcription and translation terminator and a polyadenylation signal. By way of example, such constructs will typically include a 5' LTR, a tRNA binding site, a packaging signal, an origin of second-strand DNA synthesis, and a 3' LTR or a portion thereof.

When secretion of the polypeptides is desired the polynucleotides of the invention can be expressed as fusion polypeptides comprising the nucleic acid sequence encoding the PGL or BRX gene ligated in frame to a nucleic acid sequence encoding a signal peptide that provides for secretion.

DNA encoding suitable signal sequences can be derived from genes for secreted bacterial proteins, such as the *E. coli* outer membrane protein gene (ompA) (Masui et al. (1983) FEBS Lett. 151(1):159-164; Ghrayeb et al. (1984) EMBO J. 3:2437-2442) and the *E. coli* alkaline phosphatase signal sequence (phoA) (Oka et al. (1985) Proc. Natl. Acad. Sci. 82:7212). Other prokaryotic signals include, for example, the signal sequence from penicillinase, Ipp, or heat stable enterotoxin II leaders.

According to a specific embodiment, the nucleic acid construct comprises a plurality of cloning sites for ligating a nucleic acid sequence of the invention such that it is under transcriptional regulation of the regulatory regions.

Selectable marker genes that ensure maintenance of the vector in the cell can also be included in the expression vector. Preferred selectable markers include those which confer resistance to drugs such as ampicillin, chloramphenicol, erythromycin, kanamycin (neomycin), and tetracycline (Davies et al. (1978) Annu. Rev. Microbiol. 32:469). Selectable markers can also allow a cell to grow on minimal medium, or in the presence of toxic metabolite and can include biosynthetic genes, such as those in the histidine, tryptophan, and leucine biosynthetic pathways.

In the construction of the expression vector, the promoter is preferably positioned approximately the same distance from the heterologous transcription start site as it is from the transcription start site in its natural setting. As is known in the art, however, some variation in this distance can be accommodated without loss of promoter function.

Other than containing the necessary elements for the transcription and translation of the inserted coding sequence, the expression construct of some embodiments of the invention can also include sequences engineered to enhance stability, production, purification, yield or toxicity of the expressed polypeptide.

Where appropriate, the polynucleotides may be optimized for increased expression in the transformed organism. For example, the polynucleotides can be synthesized using preferred codons for improved expression.

Various methods known within the art can be used to introduce the expression vector of some embodiments of the invention into cells. Such methods are generally described in Sambrook et al., Molecular Cloning: A Laboratory Manual, Cold Springs Harbor Laboratory, New York (1989, 1992), in Ausubel et al., Current Protocols in Molecular Biology, John Wiley and Sons, Baltimore, Md. (1989), Chang et al., Somatic Gene Therapy, CRC Press, Ann Arbor, Mich. (1995), Vega et al., Gene Targeting, CRC Press, Ann Arbor Mich. (1995), Vectors: A Survey of Molecular Cloning Vectors and Their Uses, Butterworths, Boston Mass. (1988) and Gilboa et at. [Biotechniques 4 (6): 504-512, 1986] and include, for example, stable or transient transfection, natural or induced transformation, lipofection, electroporation and infection with recombinant viral vectors. In addition, see U.S. Pat. Nos. 5,464,764 and 5,487,992 for positive-negative selection methods.

Exemplary methods of introducing expression vectors into bacterial cells include for example conventional transformation or transfection techniques, or by phage-mediated infection. As used herein, the terms "transformation", "transduction", "conjugation", and "protoplast fusion" are intended to refer to a variety of art-recognized techniques for introducing foreign nucleic acid (e.g., DNA) into a cell, such as calcium chloride co-precipitation.

Introduction of nucleic acids by phage infection offers several advantages over other methods such as transformation, since higher transfection efficiency can be obtained due to the infectious nature of phages. These methods are especially useful for rendering bacteria more sensitive to phage attack for antibiotics purposes as further described hereinbelow.

It will be appreciated the BREX polypeptides can be introduced directly into the cell (e.g., bacterial cell) and not via recombinant expression to confer resistance. The term "polypeptide" as used herein encompasses native peptides (either degradation products, synthetically synthesized peptides or recombinant peptides) and peptidomimetics (typically, synthetically synthesized peptides), as well as peptoids and semipeptoids which are peptide analogs, which may have, for example, modifications rendering the peptides more stable while in a body or more capable of penetrating into cells. Such modifications include, but are not limited to N terminus modification, C terminus modification, peptide bond modification, backbone modifications, and residue modification. Methods for preparing peptidomimetic compounds are well known in the art and are specified, for example, in Quantitative Drug Design, C. A. Ramsden Gd., Chapter 17.2, F. Choplin Pergamon Press (1992), which is incorporated by reference as if fully set forth herein.

The polypeptides of the present invention may be synthesized by any techniques known to those skilled in the art of peptide synthesis, for example but not limited to recombinant DNA techniques or solid phase peptide synthesis.

Thus, regardless of the method of introduction, the present teachings provide for an isolated cell (e.g., bacterial cell) which comprises a heterologous BREX system, as described herein.

According to specific embodiments, the isolated cell is transformed or transfected with the above-mentioned nucleic acid construct or nucleic acid construct system.

According to an aspect of the present invention, there is provided an isolated cell genetically modified to express a BREX system selected from the group consisting of (1) brxC/pglY, pglZ and at least one of pglX, pglXI, brxP, brxHI, brxHII, brxL, brxD, brxA, brxB, brxF, and brxE, with the proviso that the BREX system does not comprise pglW, (2) brxC/pglY, pglZ, pglX, pglW and at least one of brxD and brxHI, (3i) brxA, brxB, brxC/pglY, pglX, pglZ and brxL.

(3ii) brxA, brxB, (brxC/pglY)$_{x2}$, pglX, pglZ and brxHII.

(3iii) brxE, brxA, brxB, brxC/pglY, pglX, pglZ, brxD and brxHI, (3iv) brxF, brxC/pglY, pglXI, brxHII, pglZ and brxA, (3v) pglW, pglX, brxC/pglY, pglZ, brxD and brxHI, or (3vi) brxP, brxC/pglY, pglZ and brxL.

According to another aspect of the present invention there is provided an isolated cell genetically modified to express a BREX system polypeptide selected from the group consisting of pglX, brxP, brxHI, brxHII, brxL, brxD, brxA, brxB, brxF, and brxE.

According to specific embodiments there is provided an isolated cell genetically modified to express a BREX system polypeptide comprising an amino acid sequence of a COG0515 domain, said polypeptide conferring resistance to a first cycle phage infection.

According to specific embodiments there is provided an isolated cell genetically modified to express a BREX system polypeptide comprising an amino acid sequence of a pfam13659 domain, said polypeptide conferring resistance to a first cycle phage infection.

According to specific embodiments there is provided an isolated cell genetically modified to express a BREX system polypeptide comprising an amino acid sequence of DUF2791 and DUF499 domains, said polypeptide conferring resistance to a first cycle phage infection.

According to specific embodiments there is provided an isolated cell genetically modified to express a BREX system polypeptide comprising an amino acid sequence of a pfam08665 domain, said polypeptide conferring resistance to a first cycle phage infection.

According to specific embodiments there is provided an isolated cell genetically modified to express a pglW polypeptide with the proviso that said pglW polypeptide is not SEQ ID NO: 6110.

According to specific embodiments there is provided an isolated cell genetically modified to express a pglX polypeptide with the proviso that said pglX polypeptide is not SEQ ID NO: 2949.

According to specific embodiments there is provided an isolated cell genetically modified to express a brxC/pglY polypeptide with the proviso that said brxC/pglY polypeptide is not SEQ ID NO: 802.

According to specific embodiments there is provided an isolated cell genetically modified to express a pglZ polypeptide with the proviso that said pglZ polypeptide is not SEQ ID NO: 1890.

According to specific embodiment the isolated cell (e.g., bacterial cell) does not express a BREX system endogenously.

The term "endogenous" as used herein, refers to the expression of the native gene in its natural location and expression level in the genome of an organism.

The expression of the polynucleotide can be episomal or integrated into the chromosome of the cell.

According to specific embodiments the isolated cell is resistant to a first cycle phage infection.

According to specific embodiments the isolated cell is resistant to lytic phage.

According to specific embodiments the isolated cell is resistant to temperate (also referred as lysogenic) phage.

According to a specific embodiment the isolated cell is resistant to phage lysogeny.

According to another specific embodiment the isolated cell is resistant to phage DNA replication.

According to specific embodiments the isolated cell is a microbial cell such as a bacterial cell.

As used herein, the term "bacteria" refers to all prokaryotes and includes both bacteria and archaea.

Indeed, it is intended that any bacterial species (e.g., which does not express a PYZA system) will find use in the present invention. Thus, the bacteria may be for example gram-positive or gram-negative bacteria.

The phrase "Gram-positive bacteria" as used herein refers to bacteria characterized by having as part of their cell wall structure peptidoglycan as well as polysaccharides and/or teichoic acids and are characterized by their blue-violet color reaction in the Gram-staining procedure. Representative Gram-positive bacteria include: *Actinomyces* spp., *Bacillus anthracis, Bifidobacterium* spp., *Clostridium botulinum, Clostridium perfringens. Clostridium* spp., *Clostridium tetani, Corynebacterium diphtheriae. Corynebacteriwnum jeikeium, Enterococcus faecalis, Enterococcus faecium, Ervsipelothrix rhusiopathiae, Eubacterium* spp., *Gardnerella vaginalis, Gemella morbillorum, Leuconostoc* spp., *Mycobacterium abcessus, Mycobacterium avium complex. Mycobacterium chelonae, Mycobacterium fortuitum. Mycobacterium haemophilium, Mycobacterium kansasii, Mycobacterium leprae, Mycobacterium marinum, Mycobacterium scrofulaceum, Mycobacterium smegmatis. Mycobacterium terrae, Mycobacterium tuberculosis, Mycobacterium ulcerans, Nocardia* spp., *Peptococcus niger, Peptostreptococcus* spp., *Proprionibacterium* spp., *Staphylococcus aureus, Staphylococcus auricularis, Staphylococcus capitis, Staphylococcus colmii, Staphylococcus epidermidis, Staphylococcus haemolyticus, Staphylococcus hominis, Staphylococcus lugdanensis, Staphylococcus saccharolyticus, Staphylococcus saprophyticus, Staphylococcus schleiferi, Staphylococcus similans, Staphylococcus warneri, Staphylococcus xylosus. Streptococcus agalactiae* (group B *streptococcus*), *Streptococcus anginosus, Streptococcus bovis, Streptococcus canis. Streptococcus equi, Streptococcus milleri, Streptococcus mitior, Streptococcus mutans. Streptococcus pneumoniae, Streptococcus pyogenes* (group A *streptococcus*), *Streptococcus salivarius, Streptococcus sanguis.*

The term "Gram-negative bacteria" as used herein refers to bacteria characterized by the presence of a double membrane surrounding each bacterial cell. Representative Gram-negative bacteria include *Acinetobacter calcoaceticus, Acti-* nobacillus actinomycetemcomitans, Aeromonas hydrophila, Alcaligenes xvlosoxidans, Bacteroides. Bacteroides fragilis, Bartonella bacilliformis, Bordetella spp., Borrelia burgdorferi, Branhamella catarrhalis, Brucella spp., Campylobacter spp., Chalmydia pneumoniae, Chlamndia psittaci. Chlamydia trachomatis, Chromobacterium violaceum, Citrobacter spp., Eikenella corrodens, Enterobacter aerogenes, Escherichia coli, Flavobacterium meningosepticum, Fusobacterium spp., Haemophilus influenzae, Haemophilus spp., Helicobacter pylori, Klebsiella spp., Legionella spp., Leptospira spp., Moraxella catarrhalis, Morganella morganii, Mycoplasma pneumoniae, Neisseria gonorrhoeae, Neisseria meningitidis, Pasteurella multocida, Plesiomonas shigelloides. Prevotella spp., Proteus spp., Providencia rettgeri, Pseudomonas aeruginosa, Pseudomonas spp., Rickettsia prowazekii, Rickettsia rickettsii, Rochalimaea spp., Salmonella spp., Salmonella typhi, Serratia marcescens, Shigella spp., Treponema carateum, Treponema pallidum, Treponema pallidum endemicum, Treponema pertenue, Veillonella spp., Vibrio cholerae, Vibrio vulnificus, Yersinia enterocolitica, Yersinia pestis.

According to specific embodiments the bacteria is a species selected from the group consisting of Escherichia, Shigella, Salmonella, Erwinia, Yersinia, Bacillus, Vibrio, Legionella, Pseudomonas, Neisseria, Bordetella, Helicobacter, Listeria, Agrobacterium, Staphylococcus, Streptococcus, Enterococcus, Clostridium, Corynebacterium, Mycobacterium, Treponema, Borrelia, Francisella, Brucella, Campylobacter, Klebsiella, Frankia, Bartonella, Rickettsia, Shewanella, Serratia, Enterobacter, Proteus, Providencia, Brochothrix, Bifidobacterium, Brevibacterium, Propionibacterium. Lactococcus, Lactobacillus, Pediococcus, Leuconostoc. Oenococcus, and Propionibacterium species.

Additionally, or alternatively the bacteria may be useful in the manufacture of dairy and fermentation processing such as, but not limited to, milk-derived products, such as cheeses, yogurt, fermented milk products, sour milks, and buttermilk.

According to specific embodiments the bacteria is a lactic bacteria. As used herein the term "lactic acid bacteria" refers to Gram positive, microaerophillic or anaerobic bacteria which ferment sugar with the production of acids including lactic acid as the predominantly produced acid, acetic acid, formic acid and propionic acid.

According to specific embodiments the bacteria is a species selected from the group of the industrially most useful lactic acid bacteria consisting of Lactococcus species, Streptococcus species, Lactobacillus species, Leuconostoc species, Oenococcus species, Pediococcus species and Bifidobacterium species and Propionibacterium species.

As used herein, the term "phage" or "bacteriophage" refers to a virus that selectively infects one or more bacterial species. Many phages are specific to a particular genus or species or strain of bacteria.

According to specific embodiments, the phage is virulent to the bacteria.

According to some embodiments, the phage is a lytic phage.

According to other embodiments, the phage is temperate (also referred to as lysogenic).

A lytic phage is one that follows the lytic pathway through completion of the lytic cycle, rather than entering the lysogenic pathway. A lytic phage undergoes viral replication leading to lysis of the cell membrane, destruction of the cell, and release of progeny phage particles capable of infecting other cells.

A temperate phage is one capable of entering the lysogenic pathway, in which the phage becomes a dormant, passive part of the cell's genome through prior to completion of its lytic cycle.

Exemplary phages which fall under the scope of the invention include, but are not limited to, phages that belong to any of the following virus families: Corticoviridae, Cystoviridae, Inoviridae, Leviviridae, Microviridae, Myoviridae, Podoviridae, Siphoviridae, or Tectiviridae.

According to specific embodiments the phage is selected from the group consisting of SPβ, SP16, Zeta, Φ3T, and SPO2.

According to other specific embodiments the phage is not Φ105, rho10 and rho14.

According to specific embodiments, the lytic phage is SPO1 and/or SP82G.

According to specific embodiments, phage that infect bacteria that are pathogenic to plants and/or animals (including humans) find particular use.

According to specific embodiments, the resistance of a cell against a phage is improved as compared to a cell of the same species which was not treated according to the present teachings (i.e., with a BREX system).

The lysogenic activity of a phage can be assessed in multiple ways, including but not limited to PCR and DNA sequencing.

The DNA replication activity of a phage can be assessed in multiple ways, including but not limited to DNA sequencing and southern blot analysis.

The lytic activity of a phage can be assessed in multiple ways, including but not limited to optical density, plaque assay, and living dye indicators.

The lytic activity of a phage can be measured indirectly by following the decrease in optical density of the bacterial cultures owing to lysis. This method involves introduction of phage into a fluid bacterial culture medium. After a period of incubation, the phage lyses the bacteria in the broth culture resulting in a clearing of the fluid medium resulting in decrease in optical density.

Another method, known as the plaque assay, introduces phage into a few milliliters of soft agar along with some bacterial host cells. This soft agar mixture is laid over a hard agar base (seeded-agar overlay). The phage adsorb onto the host bacterial cells, infect and lyse the cells, and then begin the process anew with other bacterial cells in the vicinity. After 6-24 hours, zones of clearing on the plate known as plaques, are observable within the lawn of bacterial growth on the plate. Each plaque represents a single phage particle in the original sample.

Yet another method is the one-step phage growth curve which allows determining the production of progeny virions by cells as a function of time after infection. The assay is based on the fact that cells in the culture are infected simultaneously with a low number of phages so that no cell can be infected with more than one phage. At various time intervals, samples are removed for a plaque assay allowing quantitative determination of the number of phages present in the medium.

Other methods use for example redox chemistry, employing cell respiration as a universal reporter. During active growth of bacteria, cellular respiration reduces a dye (e.g., tetrazolium dye) and produces a color change that can be measured in an automated fashion. On the other hand, successful phage infection and subsequent growth of the phage in its host bacterium results in reduced bacterial growth and respiration and a concomitant reduction in color.

Thus, the polynucleotides, polypeptides and nucleic acid constructs of the present invention can be used in conferring phage resistance.

As used herein, "confers phage resistance" refers to an increase of at least 10% in bacterial resistance towards a phage, as may be manifested in viability. According to a specific embodiment, the increase is in at least 20%, 30%, 40% or even higher say, 50%, 60%, 70%, 80%, 90% or more than 100%.

For the same culture conditions the bacterial susceptibility towards a phage of the present invention is generally expressed in comparison to the wild-type bacteria. As used herein, the phrase "increased resistance towards a phage" means that the level of phage infection and/or multiplication in the bacteria does not cause a deleterious effect to the bacteria e.g., growth arrest or death.

In some embodiments, the bacteria have about 100-100.000 times lower efficiency of plaquing ([EOP]=10-2), about 1000 times lower EOP (EOP=$10^{-3}$), 10,000 times lower EOP (EOP=10-4), or 100,000 times lower EOP (EOP=10-5). In some embodiments, the level of phage multiplication in a culture is measured after about 6-14 hours incubation of the culture, e.g., after about 12 hours, after about 9 hours, after about 8 hours after about 7 hours, or after about 6 hours.

Thus, according to specific embodiments there is provided a method of protecting bacteria from phage attack, the method comprising introducing into or expressing in the bacteria a BREX system, thereby protecting the bacteria from phage attack.

According to specific embodiments the bacteria does not express a BREX system endogenously.

Various modalities may be used to introduce or express the BREX system in the bacteria.

Thus, according to specific embodiments, the method is effected by expressing in the bacteria, the isolated polynucleotides, nucleic acid construct or construct system or alternatively introducing the BREX polypeptides as described herein to confer protection.

According to another embodiment the BREX system is introduced into the bacteria via a transmissible genetic element in a process of bacterial conjugation.

As used herein, the phrase "bacterial conjugation" refers to a direct transfer of genetic material between bacterial cells by cell-to-cell contact or by bridge-like connection between the cells. During conjugation the donor bacteria provides a transmissible genetic element, typically a plasmid or a transposon. The transfer of the transmissible genetic element tale advantage of the complementary nature of double stranded DNA. Thus, one strand of the transmissible genetic element is transferred and the other remains in the original bacteria. Both strands have the complementary stranded added so that each bacteria ends up with a complete transmissible element.

According to a specific embodiment, there is provided a method of protecting first bacteria from phage attack, the method comprising contacting the first bacteria with second bacteria which expresses on a transmissible genetic element a BREX system, wherein the first bacteria and the second bacteria are non identical; thereby protecting the bacteria from phage attack.

As used herein, the term "contacting" refers to the step of incubation of the bacterial cell (e.g., first bacteria) with a substance or cell (e.g., second bacteria) such that the substance or a substance contained in the cell affects phage resistance of the bacterial cell.

According to specific embodiments the first bacteria does not express a BREX system endogenously.

As used herein the phrase "transmissible genetic element" refers to a nucleic acid sequence that can be transferred naturally from one bacteria to another.

According to specific embodiments the transmissible genetic element comprises a conjugative genetic element or a conjugative plasmid or mobilizable genetic element.

As used herein, a "conjugative plasmid" refers to a plasmid that is transferred from one bacterial cell to another during conjugation.

As used herein, the term "mobilizable element" refers to a transposon, which is a DNA sequence that can change its position within the genome.

According to a specific embodiment, the first bacteria is the industrially valuable bacteria such as those used for fermentation as described above.

Thus, following the above teachings there is provided an isolated bacteria comprising a nucleic acid sequence encoding a BREX system and a transmissible genetic element expressing the BREX system, wherein the isolated bacteria does not endogenously express the BREX system and wherein the BREX system comprises brxC/pglY, pglZ and at least one of pglX, pglXI, brxP, brxHI, brxHII, brxL, brxD, brxA, brxB, brxF, and brxE, with the proviso that the BREX system does not comprise pglW, or comprises brxC/pglY, pglZ, pglX, pglW and at least one of brxD and brxHI.

Cultures, and starter cultures, in particular are used extensively in the food industry in the manufacture of fermented products including milk products (e.g., yogurt, buttermilk, and cheese), meat products, bakery products, wine, and vegetable products. The preparation of cultures is labor intensive, occupying much space and equipment, and there is a considerable risk of contamination with spoilage bacteria and/or phages during the propagation steps. The failure of bacterial cultures due to phage infection and multiplication is a major problem with the industrial use of bacterial cultures. There are many different types of phages and new strains continue to emerge. Indeed, despite advances in culture development, there is a continuing need to improve cultures for use in industry.

Thus, according to an aspect of the present invention, there is provided a method for preparing a food, food additive, feed, nutritional supplement, probiotic supplement, a personal care product, a health care product, and a veterinary product comprising adding to the food, food additive, feed, nutritional supplement, probiotic supplement, a personal care product, a health care product, and a veterinary product the isolated BREX system polynucleotide, the BREX system construct, the isolated cell or the isolated bacteria of the present invention, thereby preparing the food, food additive, feed, nutritional supplement, probiotic supplement, personal care product, health care product, and veterinary product.

Thus, following the above teachings there is provided a food, food additive, feed, nutritional supplement, probiotic supplement, a personal care product, a health care product, and a veterinary product comprising the isolated BREX system polynucleotide, the BREX system construct, the isolated cell or the isolated bacteria of the present invention.

According to another aspect of the present invention, there is provided a method for preparing a food, food additive, feed, nutritional supplement, probiotic supplement, a personal care product, a health care product, and a veterinary product comprising adding to the food, food additive, feed, nutritional supplement, probiotic supplement, a personal care product, a health care product, and a veterinary product a bacteria which expresses on a transmissible genetic element a BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW, or comprising brxC/pglY, pglZ, pglX, pglW and at least one of brxD and brxHI, thereby preparing the food, food additive, feed, nutritional supplement, probiotic supplement, personal care product, health care product, and veterinary product.

According to specific embodiments the food or feed is a dairy product.

The preparation of starter cultures of such bacteria, and methods of fermenting substrates, particularly food substrates such as milk, can be carried out in accordance with known techniques, including but not limited to those described in Mayra-Makinen and Bigret (1993) Lactic Acid Bacteria; Salminen and vonWright eds. Marcel Dekker, Inc. New York. 65-96; Sandine (1996) Dairy Starter Cultures Cogan and Accolas eds. VCH Publishers, New York. 191-206; Gilliland (1985) Bacterial Starter Cultures for Food. CRC Press, Boca Raton. Fla.

The term "fermenting" refers to the energy-yielding, metabolic breakdown of organic compounds by microorganisms that generally proceeds under anaerobic conditions and with the evolution of gas.

Products produced by fermentation which have been known to experience phage infection, and the corresponding infected fermentation bacteria, include cheddar and cottage cheese (*Lactococcus lactis* subsp. *lactis, Lactococcus lactis* subsp. *cremoris*), yogurt (*Lactobacillus delbrueckii* subsp. *bulgaricus, Streptococcus thermophilus*). Swiss cheese (*S. thermophilus, Lactobacillus lactis, Lactobacillus helveticus*), blue cheese (*Leuconostoc cremoris*), Italian cheese (*L. bulgaricus, S. thermophilus*), viili (*Lactococcus lactis* subsp. *cremoris. Lactococcus lactis* subsp. *lactis biovar diacetylactis, Leuconostoc cremoris*), yakult (*Lactobacillus casei*), casein (*Lactococcus lactis* subsp. *cremoris*), natto (*Bacillus subtilis* var. *natto*), wine (*Leuconostoc oenos*), sake (*Leuconostoc mesenteroides*), polymyxin (*Bacillus polymyxa*), colistin (*Bacillus colistrium*), bacitracin (*Bacillus licheniformis*), L-glutamic acid (*Brevibacterium lactofermentum, Microbacterium ammoniaphilum*), and acetone and butanol (*Clostridium acetobutylicum. Clostridium saccharoperbutvlacetonicum*).

The present inventors have uncovered that transformation of a *Bacillus subtilis* strain with a non-complete type 1 BREX (i.e. not expressing pglX) does not confer phage resistance. In addition it was also discovered that a frame shift mutation in a BREX gene (i.e., pglX) in one of the *Bacillus subtilis* strains transformed with type 1 BREX resulted in aberrant BREX system that was not active against any of the tested phages, indicating that down regulation of a BREX gene can render a bacteria resistant to phage infection. These results suggest the use of anti BREX agents as a method to induce phage sensitivity.

As used herein, "inducing phage sensitivity" refers to an increase of at least 10% in bacterial susceptibility towards a phage, as may be manifested in growth arrest or death. According to a specific embodiment, the increase is in at least 20%, 30%, 40% or even higher say, 50%, 60%, 70%, 80%, 90% or more than 100%.

For the same culture conditions, the bacterial susceptibility towards a phage of the present invention is generally expressed in comparison to the wild-type bacteria. As used herein, the phrase "increased susceptibility towards a phage" means that the level of phage infection and/or multiplication in the bacteria cause a deleterious effect to the bacteria e.g., growth arrest or death.

Thus, according to further aspect of the present invention, there is provided a method of inducing phage sensitivity in a bacterial cell, the method comprising contacting a bacterial cell which expresses a BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW, or comprising brxC/pglY, pglZ, pglX, pglW and at least one of brxD and brxHI; with an anti BREX system agent capable of down regulating a BREX gene selected from the group consisting of brxC/pglY, pglZ, pglX, pglX, brxP, brxHI, brxHI, brxL, brxD, brxA, brxB, brxF, brxE, and pglW, thereby inducing sensitivity of the bacterial cell to phage infection.

As used herein the phrase "anti BREX system agent" is an agent capable of specifically inhibiting or "silencing" the expression of a target BREX gene or alternatively specifically impairs the functionality of the target BREX protein. According to specific embodiments the anti BREX system agent is directed against pglX. For example, the anti-BREX system may interfere with pglX expression (as described hereinbelow) or in its DNA methyltransferase function by the use of common inhibitors of such an enzyme e.g., 5-Azacytidine. Decitabine Zebularine, RG108, Hydralazine hydrochloride, and Psammaplin A.

According to other specific embodiments the anti BREX system agent is directed against brxC/pglY or pglZ.

Down regulation of BREX system can be effected on the genomic and/or the transcript level using a variety of molecules which interfere with transcription and/or translation (e.g., RNA silencing agents), or on the protein level using e.g., aptamers, small molecules and inhibitory peptides, antagonists, enzymes that cleave the polypeptide and the like.

According to specific embodiments the anti BREX system agent is selected from the group consisting of a nucleic acid suitable for silencing expression, aptamers, small molecules and inhibitory peptides.

As used herein the phrase "nucleic acid suitable for silencing expression" refers to regulatory mechanisms mediated by nucleic acid molecules which result in the inhibition or "silencing" of the expression of a corresponding protein-coding gene. Numerous methods are known in the art for gene silencing in prokaryotes. Examples include but are not limited to U.S. Patent Application 20040053289 which teaches the use of si hybrids to down-regulate prokaryotic genes, and U.S. Patent Application PCT/US09/69258 which teaches the use of CRISPR to downregulate prokaryotic genes. Alternatively the inhibition can be carried out at the protein level which interferes with protein activity, such as by the use of aptamers. Various methods are known in the art which can be used to design protein specific aptamers. The skilled artisan can employ SELEX (Systematic Evolution of Ligands by Exponential Enrichment) for efficient selection as described in Stoltenburg R, Reinemann C, and Strehlitz B (Biomolecular engineering (2007) 24(4):381-403).

As used herein an "aptamer" refers to double stranded DNA or single stranded RNA molecule that binds to specific molecular target, such as a protein.

Alternatively or additionally, small molecule or peptides can be used which interfere with the BREX protein function (e.g., catalytic or interaction).

Specifically, contacting is effected such that the positioning of the anti BREX system agent is in direct or indirect contact with the bacterial cell. Thus, the present invention contemplates both applying the anti BREX system agents of the present invention to a desirable surface and/or directly to the bacterial cells.

According to another embodiment the surface is comprised in a biological tissue, such as for example, mammalian tissues e.g. the skin.

It will be appreciated that the bacteria may be comprised inside a particular organism, (e.g. intracellularly or extracellularly) for example inside a mammalian body or inside a plant. In this case, the contacting may be effected by administering the anti BREX agents per se or by transfecting the cells of the organism with the anti BREX agents of the present invention.

Thus, according to a specific embodiment contacting with an anti BREX system agent is effected in-vivo.

According to another specific embodiment contacting with an anti BREX system agent is effected ex-vivo.

According to another specific embodiment contacting with an anti BREX system agent is effected in-vitro.

According to specific embodiments, there is provided an isolated bacteria generated by contacting bacteria with anti BREX system agent in-vitro or ex-vivo.

According to some embodiments, a BREX system or an anti-BREX system agent is provided in a formulation suitable for cell penetration that enhances intracellular delivery of BREX system.

Any suitable penetrating agent for enhancing penetration of BREX system or anti BREX system agent to cell (e.g., bacteria) may be used, as known by those of skill in the art. Examples include but are not limited to:

Phages—Phages offer several advantages including lateral infection, higher efficiency of transformation, and targeting to, and propagation in, specific bacteria.

Cell-Penetrating Peptides (CPPs)—CPPs, for example TAT (transcription activator from HIV-1) are short peptides (≤40 amino acids), with the ability to gain access to the interior of almost any cell. They are highly cationic and usually rich in arginine and lysine amino acids. They have the exceptional property of carrying into the cells a wide variety of covalently and noncovalently conjugated cargoes such as proteins, oligonucleotides, and even 200 nm liposomes. Protocols for producing CPPs-cargos conjugates and for infecting cells with such conjugates can be found, for example L. Theodore et al. [The Journal of Neuroscience, (1995) 15(11): 7158-7167], Fawell S, et al. [Proc Natl Acad Sci USA, (1994) 91:664-668], and Jing Bian et al. [Circulation Research. (2007) 100: 1626-1633].

The expression level and/or activity level of the BREX system expressed in the cells of some embodiments of the invention can be determined using methods known in the arts, e.g. but not limited to selectable marker gene, Northern blot analysis, PCR analysis, DNA sequencing, RNA sequencing, Western blot analysis, and Immunohistochemistry.

According to another aspect of the present invention, there is provided a method of treating a microbial infection in a subject in need thereof, the method comprising contacting the bacteria with an anti BREX system agent capable of down regulating a BREX gene selected from the group consisting of brxC/pglY, pglZ, pglX, pglXI, brxP, brxHI, brxHII, brxL, brxD, brxA, brxB, brxF, brxE, and pglW, thereby treating the infection.

As used herein, the term "treating" refers to curing, reversing, attenuating, alleviating, minimizing, suppressing or halting the deleterious effects of a pathogen infection.

As used herein, the phrase "subject in need thereof" includes mammals, preferably human beings at any age which suffer from pathogen infection.

The anti BREX system agent may be used alone or together with additional antimicrobial agents (e.g. phage therapy, antibiotic and/or additional anti microbial peptides).

According to specific embodiments the methods of the present invention further comprise administering to the subject a phage therapy.

According to other specific embodiments the methods of the present invention further comprise administering to the subject an antibiotic.

Exemplary antibiotics include, but are not limited to aminoglycoside antibiotics, cephalosporins, quinolone antibiotics, macrolide antibiotics, penicillins, sulfonamides, tetracyclines and carbapenems. It will be appreciated that since the polypeptides of embodiments of this invention enhance the antibacterial effect of the antibiotic, doses of the antibiotic may be lower (e.g. 20% lower, 30% lower, 40% lower, 50% lower, 60% lower, 70% lower, 80% lower or even 90% lower than those currently in use.

The BREX system or the anti-BREX system agent of some embodiments of the invention can be administered to a starter culture, a fermentation vat or an organism per se, or in a composition where it is mixed with suitable carriers or excipients.

According to an aspect of the present invention there is provided a phage defense composition, comprising as an active ingredient a BREX system comprising brxC/pglY, pglZ and at least one of pglX, pglXI, brxP, brxHII, brxHII, brxL, brxD, brxA, brxB, brxF, and brxE, with the proviso that the BREX system does not comprise pglW, or comprising brxC/pglY, pglZ, pglX, pglW and at least one of brxD and brxHI; and an acceptable carrier or diluent.

According to another aspect of the present invention there is provided an anti-microbial composition comprising as active ingredient an anti BREX system agent capable of down regulating a BREX gene selected from the group consisting of brxC/pglY, pglZ, pglX, pglXI, brxP, brxHI, brxHII, brxL, brxD, brxA, brxB, brxF, brxE, and pglW, and an acceptable carrier or diluent.

As used herein, the phrase "anti-microbial activity", refers to an ability to suppress, control, inhibit or kill a bacteria. Thus, for example the anti-microbial activity may comprise bactericidal or bacteriostatic activity, or both.

According to specific embodiments the composition is a pharmaceutical composition and the carrier is a pharmaceutically acceptable carrier.

The phrase "pharmaceutical composition" as used herein refers to a preparation of one or more of the active ingredients described herein with other chemical components such as physiologically suitable carriers and excipients. The purpose of a pharmaceutical composition is to facilitate administration of a compound to an organism.

Hereinafter, the phrases "physiologically acceptable carrier" and "pharmaceutically acceptable carrier" which may be interchangeably used refer to a carrier or a diluent that does not cause significant irritation to an organism and does not abrogate the biological activity and properties of the administered compound. An adjuvant is included under these phrases.

Herein, the term "excipient" refers to an inert substance added to a pharmaceutical composition to further facilitate administration of an active ingredient. Examples, without limitation, of excipients include calcium carbonate, calcium phosphate, various sugars and types of starch, cellulose derivatives, gelatin, vegetable oils, and polyethylene glycols.

As used herein the term "active ingredient" refers to any one of BREX system polypeptide or polynucleotide, anti-BREX system agent capable of down regulating a BREX gene or cells generated according to the present teachings, accountable for the biological effect.

Techniques for formulation and administration of drugs may be found in the latest edition of "Remington's Pharmaceutical Sciences," Mack Publishing Co., Easton, Pa., which is herein fully incorporated by reference and are further described herein below.

It will be appreciated that the polypeptides, polynucleotides, or other agents of the present invention can be provided to the individual with additional active agents to achieve an improved therapeutic effect as compared to treatment with each agent by itself.

Exemplary additional agents include phage therapy, and antibiotics (e.g. rifampicin, chloramphenicol and spectinomycin).

According to specific embodiment the anti-microbial composition further comprises a phage.

Suitable routes of administration may, for example, include oral, rectal, transmucosal, especially transnasal, intestinal or parenteral delivery, including intramuscular, subcutaneous and intramedullary injections as well as intrathecal, direct intraventricular, intracardiac, e.g., into the right or left ventricular cavity, into the common coronary artery, intravenous, intraperitoneal, intranasal, or intraocular injections.

Conventional approaches for drug delivery to the central nervous system (CNS) include: neurosurgical strategies (e.g., intracerebral injection or intracerebroventricular infusion); molecular manipulation of the agent (e.g., production of a chimeric fusion protein that comprises a transport peptide that has an affinity for an endothelial cell surface molecule in combination with an agent that is itself incapable of crossing the BBB) in an attempt to exploit one of the endogenous transport pathways of the BBB; pharmacological strategies designed to increase the lipid solubility of an agent (e.g., conjugation of water-soluble agents to lipid or cholesterol carriers); and the transitory disruption of the integrity of the BBB by hyperosmotic disruption (resulting from the infusion of a mannitol solution into the carotid artery or the use of a biologically active agent such as an angiotensin peptide). However, each of these strategies has limitations, such as the inherent risks associated with an invasive surgical procedure, a size limitation imposed by a limitation inherent in the endogenous transport systems, potentially undesirable biological side effects associated with the systemic administration of a chimeric molecule comprised of a carrier motif that could be active outside of the CNS, and the possible risk of brain damage within regions of the brain where the BBB is disrupted, which renders it a suboptimal delivery method.

Alternately, one may administer the pharmaceutical composition in a local rather than systemic manner, for example, via injection of the pharmaceutical composition directly into a tissue region of a patient.

Pharmaceutical compositions of the present invention may be manufactured by processes well known in the art, e.g., by means of conventional mixing, dissolving, granulating, dragee-making, levigating, emulsifying, encapsulating, entrapping or lyophilizing processes.

Pharmaceutical compositions for use in accordance with the present invention may be formulated in conventional manner using one or more physiologically acceptable carriers comprising excipients and auxiliaries, which facilitate processing of the active ingredients into preparations which, can be used pharmaceutically. Proper formulation is dependent upon the route of administration chosen.

For injection, the active ingredients of the invention may be formulated in aqueous solutions, preferably in physiologically compatible buffers such as Hank's solution, Ringer's solution, or physiological salt buffer. For transmucosal administration, penetrants appropriate to the barrier to be permeated are used in the formulation. Such penetrants are generally known in the art.

For oral administration, the compounds can be formulated readily by combining the active compounds with pharmaceutically acceptable carriers well known in the art. Such carriers enable the compounds of the invention to be formulated as tablets, pills, dragees, capsules, liquids, gels, syrups, slurries, suspensions, and the like, for oral ingestion by a patient. Pharmacological preparations for oral use can be made using a solid excipient, optionally grinding the resulting mixture, and processing the mixture of granules, after adding suitable auxiliaries if desired, to obtain tablets or dragee cores. Suitable excipients are, in particular, fillers such as sugars, including lactose, sucrose, mannitol, or sorbitol; cellulose preparations such as, for example, maize starch, wheat starch, rice starch, potato starch, gelatin, gum tragacanth, methyl cellulose, hydroxypropylmethyl-cellulose, sodium carbomethylcellulose; and/or physiologically acceptable polymers such as polyvinylpyrrolidone (PVP). If desired, disintegrating agents may be added, such as cross-linked polyvinyl pyrrolidone, agar, or alginic acid or a salt thereof such as sodium alginate.

Dragee cores are provided with suitable coatings. For this purpose, concentrated sugar solutions may be used which may optionally contain gum arabic, talc, polyvinyl pyrrolidone, carbopol gel, polyethylene glycol, titanium dioxide, lacquer solutions and suitable organic solvents or solvent mixtures. Dyestuffs or pigments may be added to the tablets or dragee coatings for identification or to characterize different combinations of active compound doses.

Pharmaceutical compositions, which can be used orally, include push-fit capsules made of gelatin as well as soft, sealed capsules made of gelatin and a plasticizer, such as glycerol or sorbitol. The push-fit capsules may contain the active ingredients in admixture with filler such as lactose, binders such as starches, lubricants such as talc or magnesium stearate and, optionally, stabilizers. In soft capsules, the active ingredients may be dissolved or suspended in suitable liquids, such as fatty oils, liquid paraffin, or liquid polyethylene glycols. In addition, stabilizers may be added. All formulations for oral administration should be in dosages suitable for the chosen route of administration.

For buccal administration, the compositions may take the form of tablets or lozenges formulated in conventional manner.

For administration by nasal inhalation, the active ingredients for use according to the present invention are conveniently delivered in the form of an aerosol spray presentation from a pressurized pack or a nebulizer with the use of a suitable propellant, e.g., dichlorodifluoromethane, trichlorofluoromethane, dichloro-tetrafluoroethane or carbon dioxide. In the case of a pressurized aerosol, the dosage unit may be determined by providing a valve to deliver a metered amount. Capsules and cartridges of, e.g., gelatin for use in a dispenser may be formulated containing a powder mix of the compound and a suitable powder base such as lactose or starch.

The preparations described herein may be formulated for parenteral administration, e.g., by bolus injection or continuous infusion. Formulations for injection may be presented in unit dosage form, e.g., in ampoules or in multidose containers with optionally, an added preservative. The compositions may be suspensions, solutions or emulsions in oily or aqueous vehicles, and may contain formulatory agents such as suspending, stabilizing and/or dispersing agents.

Pharmaceutical compositions for parenteral administration include aqueous solutions of the active preparation in water-soluble form. Additionally, suspensions of the active ingredients may be prepared as appropriate oily or water based injection suspensions. Suitable lipophilic solvents or vehicles include fatty oils such as sesame oil, or synthetic fatty acids esters such as ethyl oleate, triglycerides or liposomes. Aqueous injection suspensions may contain substances, which increase the viscosity of the suspension, such as sodium carboxymethyl cellulose, sorbitol or dextran. Optionally, the suspension may also contain suitable stabilizers or agents which increase the solubility of the active ingredients to allow for the preparation of highly concentrated solutions.

Alternatively, the active ingredient may be in powder form for constitution with a suitable vehicle, e.g., sterile, pyrogen-free water based solution, before use.

The preparation of the present invention may also be formulated in rectal compositions such as suppositories or retention enemas, using, e.g., conventional suppository bases such as cocoa butter or other glycerides.

The preparation of the present invention may also be formulated as a topical composition, such as a spray, a cream, a mouthwash, a wipe, a foam, a soap, an oil, a solution, a lotion, an ointment, a paste, a gel and a patch.

Pharmaceutical compositions suitable for use in context of the present invention include compositions wherein the active ingredients are contained in an amount effective to achieve the intended purpose. More specifically, a therapeutically effective amount means an amount of active ingredients effective to prevent, alleviate or ameliorate symptoms of disease (e.g., bacterial infection) or prolong the survival of the subject being treated.

Determination of a therapeutically effective amount is well within the capability of those skilled in the art.

For any preparation used in the methods of the invention, the therapeutically effective amount or dose can be estimated initially from in vitro assays. For example, a dose can be formulated in animal models and such information can be used to more accurately determine useful doses in humans.

Toxicity and therapeutic efficacy of the active ingredients described herein can be determined by standard pharmaceutical procedures in vitro, in cell cultures or experimental animals. The data obtained from these in vitro and cell culture assays and animal studies can be used in formulating a range of dosage for use in human. The dosage may vary depending upon the dosage form employed and the route of administration utilized. The exact formulation, route of administration and dosage can be chosen by the individual physician in view of the patient's condition. [See e.g., Fingl, et al., (1975) "The Pharmacological Basis of Therapeutics", Ch. 1 p. 1].

Depending on the severity and responsiveness of the condition to be treated, dosing can be of a single or a plurality of administrations, with course of treatment lasting from several days to several weeks or until cure is effected or diminution of the disease state is achieved.

The amount of a composition to be administered will, of course, be dependent on the subject being treated, the severity of the affliction, the manner of administration, the judgment of the prescribing physician, etc.

Compositions of some embodiments of the invention may, if desired, be presented in a pack or dispenser device, such as an FDA approved kit, which may contain one or more unit dosage forms containing the active ingredient. The pack may, for example, comprise metal or plastic foil, such as a blister pack. The pack or dispenser device may be accompanied by instructions for administration. The pack or dispenser may also be accommodated by a notice associated with the container in a form prescribed by a governmental agency regulating the manufacture, use or sale of pharmaceuticals, which notice is reflective of approval by the agency of the form of the compositions or human or veterinary administration. Such notice, for example, may be of labeling approved by the U.S. Food and Drug Administration for prescription drugs or of an approved product insert. Compositions comprising a preparation of the invention formulated in a compatible pharmaceutical carrier may also be prepared, placed in an appropriate container, and labeled for treatment of an indicated condition, as is further detailed above.

According to another aspect there is provided an article of manufacture or a kit identified for killing a bacteria comprising a packaging material packaging an anti BREX system agent capable of down regulating a BREX gene selected from the group consisting of brxC/pglY, pglZ, pglX, pglXI, brxP, brxHI, brxHII, brxL, brxD, brxA, brxB, brxF, brxE, and pglW, and a phage.

According to specific embodiments the anti BREX system agent and the phage are packaged in separate containers.

According to yet other specific embodiments the anti BREX system agent and the phage are in c-formulation.

According to further aspect of the present invention there is provided a method of screening for identifying phage useful for infecting a bacteria, the method comprising:

(a) contacting a phage with a bacteria expressing BREX system comprising brxC/pglY, pglZ and at least one of pglX, pglXI, brxP, brxHI, brxHII, brxL, brxD, brxA, brxB, brxF, and brxE, with the proviso that the BREX system does not comprise pglW or comprising brxC/pglY, pglZ, pglX, pglW and at least one of brxD and brxHI;

(b) monitoring phage sensitivity of the bacteria, wherein an increase in phage sensitivity of the bacteria in the presence of the phage compared to phage sensitivity in the absence of the phage is indicative of a phage useful for infecting the bacteria.

The method comprising further isolating the phage characterizing it in terms of sequencing and compatibility with phages species and the ability to infect different bacterial species.

Tables 2-8 and 10-16 below demonstrate the six types of BREX system in a diverse array of bacteria and archaea genomes.

TABLE 2

BREX type 1 systems

| Organism | Genomic Start Point | Genomic End Point | BrxA* | BrxB* | BrxC* | PglX* | PglZ* | BrxL* | Methylase state | Replicon Type |
|---|---|---|---|---|---|---|---|---|---|---|
| *Acidiphilium multivorum* AIU301 uid63345 | 497519 | 512043 | YP_004282676.1/ 4953 | YP_004282675.1/ 5570 | YP_004282674.1/ 617 | YP_004282672.1/ 2766 YP_004282673.1/ 2767 | YP_004282670.1/ 1716 | YP_004282669.1/ 4300 | Split methylase. | chromosome |
| *Acidithiobacillus ferrivorans* SS3 uid67387 | 2361379 | 2377748 | YP_004784791.1/ 4954 | YP_004784792.1/ 5571 | YP_004784793.1/ 618 | YP_004784794.1/ 2768 YP_004784796.1/ 2769 | YP_004784799.1/ 1717 | YP_004784800.1/ 4301 | Split methylase. | chromosome |
| *Acinetobacter baumannii* AYE uid61637 | 53842 | 68427 | YP_001708756.1/ 4955 | YP_001708755.1/ 5572 | YP_001708754.1/ 619 | YP_001708753.1/ 2770 | YP_001708751.1/ 1718 | YP_001708750.1/ 4302 | | plasmid |
| *Anaeromyxobacter dehalogenans* 2CP C uid58135 | 3688396 | 3701032 | YP_466441.1/ 4957 | YP_466440.1/ 5574 | YP_466439.1/ 621 | YP_466438.1/ 2772 | YP_466437.1/ 1720 | YP_466436.1/ 4303 | | chromosome |
| *Aromatoleum aromaticum* EbN1 uid58231 | 3091305 | 3115716 | YP_159986.1/ 4958 | YP_159987.1/ 5575 | YP_159988.1/ 622 | YP_159991.1/ 2773 | YP_160004.1/ 1721 | YP_160005.1/ 4304 | | chromosome |
| *Burkholderia* CCGE1001 uid42975 | 3119206 | 3136704 | YP_004229224.1/ 4963 | YP_004229223.1/ 5580 | YP_004229222.1/ 627 | YP_004229221.1/ 2777 | YP_004229217.1/ 1726 | YP_004229216.1/ 4309 | | chromosome |
| *Burkholderia gladioli* BSR3 uid66301 | 1574842 | 1588056 | YP_004360051.1/ 4964 | YP_004360052.1/ 5581 | YP_004360053.1/ 628 | YP_004360054.1/ 2778 | YP_004360055.1/ 1727 | YP_004360056.1/ 4310 | | chromosome |
| *Burkholderia vietnamiensis* G4 uid58075 | 2201162 | 2216554 | YP_001119856.1/ 4965 | YP_001119855.1/ 5582 | YP_001119854.1/ 629 | Missing | YP_001119851.1/ 1728 | YP_001119850.1/ 4311 | | chromosome |
| *Caldithrix nitroreducens* DSM 19672 uid60821 | 2095970 | 2108863 | YP_004052086.1/ 4966 | YP_004052085.1/ 5583 | YP_004052084.1/ 630 | YP_004052081.1/ 2779 YP_004052083.1/ 2780 | YP_004052080.1/ 1729 | YP_004052079.1/ 4312 | Split methylase. | chromosome |
| *Carboxydothermus hydrogenoformans* Z 2901 uid57821 | 2348825 | 2361903 | YP_361448.1/ 4967 | YP_361447.1/ 5584 | YP_361446.1/ 631 | YP_361445.1/ 2781 | YP_361444.1/ 1730 | YP_361443.1/ 4313 | | chromosome |
| *Chlorobium phaeobacteroides* BS1 uid58131 | 1811542 | 1826075 | YP_001960082.1/ 4968 | YP_001960081.1/ 5585 | YP_001960080.1/ 632 | YP_001960077.1/ 2782 | YP_001960076.1/ 1731 | YP_001960075.1/ 4314 | | chromosome |
| *Clostridium ljungdahlii* DSM 13528 uid50583 | 3566681 | 3580351 | YP_003781421.1/ 4971 | YP_003781420.1/ 5588 | YP_003781419.1/ 635 | YP_003781418.1/ 2786 | YP_003781417.1/ 1734 | YP_003781415.1/ 4317 | | chromosome |
| *Clostridium saccharolyticum* WM1 uid51419 | 3014510 | 3029581 | YP_003822961.1/ 4972 | YP_003822960.1/ 5589 | YP_003822959.1/ 636 | YP_003822957.1/ 2787 | YP_003822954.1/ 1735 | YP_003822953.1/ 4318 | | chromosome |
| *Clostridium saccharolyticum* WM1 uid51419 | 3993474 | 4020337 | YP_003823839.1/ 4973 | YP_003823838.1/ 5590 | YP_003823837.1/ 637 | YP_003823836.1/ 2788 | YP_003823832.1/ 1736 | YP_003823831.1/ 4319 | | chromosome |
| *Clostridium sticklandii* DSM 519 uid59585 | 1172754 | 1188586 | YP_003936059.1/ 4974 | YP_003936060.1/ 5591 | YP_003936061.1/ 638 | YP_003936062.1/ 2790 | YP_003936065.1/ 1737 | YP_003936066.1/ 4320 | | chromosome |
| *Clostridium* SY8519 uid68705 | 1975332 | 1994112 | YP_004708906.1/ 4975 | YP_004708907.1/ 5592 | YP_004708908.1/ 639 | YP_004708910.1/ 2791 | YP_004708913.1/ 1738 | YP_004708914.1/ 4321 | | chromosome |

TABLE 2-continued

BREX type 1 systems

| Organism | Genomic Start Point | Genomic End Point | BrxA* | BrxB* | BrxC* | PglX* | PglZ* | BrxL* | Methylase state | Replicon Type |
|---|---|---|---|---|---|---|---|---|---|---|
| Cupriavidus necator N 1 uid68689 | 3467559 | 3485436 | YP_004687115.1/ 4976 | YP_004687114.1/ 5593 | YP_004687113.1/ 640 | YP_004687110.1/ 2792 | YP_004687108.1/ 1739 | YP_004687107.1/ 4322 | | chromosome |
| Cyanothece PCC 8802 uid59143 | 2210340 | 2225482 | Missing | YP_003137927.1/ 5594 | YP_003137926.1/ 641 | YP_003137924.1/ 2794 YP_003137923.1/ 2795 | YP_003137920.1/ 1740 | YP_003137919.1/ 4323 | One complete methylase and one truncated. | chromosome |
| Dehalococcoides VS uid42393 | 244220 | 257903 | YP_003329752.1/ 4977 | | YP_003329751.1/ 642 | YP_003329750.1/ 2795 | YP_003329749.1/ 1741 | YP_003329748.1/ 4324 | | chromosome |
| Dehalogenimonas lykanthroporepellens BL DC 9 uid48131 | 1589660 | 1603624 | YP_003759227.1/ 4978 | YP_003759226.1/ 5595 | YP_003759225.1/ 643 | YP_003759224.1/ 2796 | YP_003759223.1/ 1742 | YP_003759222.1/ 4325 | | chromosome |
| Desulfitobacterium hafniense Y51 uid58605 | 792814 | 806836 | YP_516908.1/ 4979 | | YP_516909.1/ 644 | YP_516910.1/ 2797 | YP_516912.1/ 1743 | YP_516913.1/ 4326 | | chromosome |
| Desulfomicrobium baculatum DSM 4028 uid59217 | 1457033 | 1471353 | YP_003157843.1/ 4981 | YP_003157842.1/ 5597 | YP_003157841.1/ 646 | YP_003157840.1/ 2799 | YP_003157838.1/ 1745 | YP_003157837.1/ 4328 | | chromosome |
| Desulfovibrio magneticus RS 1 uid59309 | 4090474 | 4104148 | YP_002954994.1/ 4983 | YP_002954993.1/ 5599 | YP_002954992.1/ 648 | YP_002954991.1/ 2801 | YP_002954989.1/ 1747 | YP_002954988.1/ 4330 | | chromosome |
| Desulfovibrio vulgaris Hildenborough uid57645 | 2096179 | 2110453 | Missing | YP_011241.1/ 5600 | YP_011240.1/ 649 | YP_011237.1/ 2802 | YP_011235.1/ 1748 | YP_011234.1/ 4331 | | chromosome |
| Desulfurivibrio alkaliphilus AHT2 uid49487 | 2512936 | 2529324 | YP_003691455.1/ 4985 | YP_003691454.1/ 5602 | YP_003691453.1/ 651 | YP_003691451.1/ 2804 | YP_003691448.1/ 1750 | YP_003691447.1/ 4333 | | chromosome |
| Erwinia pyrifoliae Ep1 96 uid40659 | 3075240 | 3088692 | YP_002649786.1/ 4989 | YP_002649787.1/ 5606 | YP_002649788.1/ 655 | YP_002649789.1/ 2809 | YP_002649790.1/ 1754 | YP_002649791.1/ 4337 | | chromosome |
| Erythrobacter litoralis HTCC2594 uid58299 | 2963192 | 2977694 | YP_459832.1/ 4990 | YP_459834.1/ 5607 | YP_459835.1/ 656 | YP_459838.1/ 2810 | YP_459839.1/ 1755 | YP_459840.1/ 4338 | | chromosome |
| Escherichia coli HS uid58393 | 335287 | 354281 | YP_001457107.1/ 4993 | YP_001457108.1/ 5610 | YP_001457109.1/ 659 | YP_001457110.1/ 2814 | YP_001457111.1/ 1758 | YP_001457112.1/ 4341 | | chromosome |
| Escherichia coli O111 H 11128 uid41023 | 5250834 | 5264277 | YP_003237428.1/ 4994 | YP_003237427.1/ 5611 | YP_003237426.1/ 660 | YP_003237425.1/ 2815 | YP_003237424.1/ 1759 | YP_003237423.1/ 4342 | | chromosome |
| Escherichia fergusonii ATCC 35469 uid59375 | 13818 | 28889 | YP_002394569.1/ 4995 | YP_002394570.1/ 5612 | YP_002394571.1/ 661 | YP_002394573.1/ 2816 | YP_002394574.1/ 1760 | YP_002394575.1/ 4343 | | plasmid |
| Exiguobacterium sibiricum 255 15 uid58053 | 325862 | 338926 | YP_001812815.1/ 4996 | YP_001812816.1/ 5613 | YP_001812817.1/ 662 | YP_001812818.1/ 2817 | YP_001812819.1/ 1761 | YP_001812820.1/ 4344 | | chromosome |
| Gallionella capsiferriformans ES 2 uid51505 | 927586 | 949287 | YP_003846678.1/ 4998 | YP_003846679.1/ 5615 | YP_003846680.1/ 664 | YP_003846683.1/ 2819 | YP_003846691.1/ 1763 | YP_003846692.1/ 4346 | | chromosome |
| Gallionella capsiferriformans ES 2 uid51505 | 1651741 | 1666042 | YP_003847303.1/ 4999 | YP_003847304.1/ 5616 | YP_003847305.1/ 665 | YP_003847308.1/ 2820 | YP_003847309.1/ 1764 | YP_003847310.1/ 4347 | | chromosome |
| Geobacillus WCH70 uid59045 | 1353239 | 1364077 | YP_002949411.1/ 5000 | YP_002949412.1/ 5617 | YP_002949413.1/ 666 | YP_002949414.1/ 2821 | YP_002949415.1/ 1765 | Missing | | chromosome |

TABLE 2-continued

BREX type 1 systems

| Organism | Genomic Start Point | Genomic End Point | BrxA* | BrxB* | BrxC* | PglX* | PglZ* | BrxL* | Methylase state | Replicon Type |
|---|---|---|---|---|---|---|---|---|---|---|
| Geobacter sulfurreducens PCA uid57743 | 2316576 | 2330995 | NP_953159.2/ 5001 | NP_953158.1/ 5618 | NP_953157.1/ 667 | NP_953156.1/ 2822 | NP_953155.1/ 1766 | NP_953154.1/ 4348 | | chromosome |
| Haliscomenobacter hydrossis DSM 1100 uid66777 | 16081 | 32343 | YP_004451379.1/ 5002 | YP_004451378.1/ 5619 | YP_004451377.1/ 668 | YP_004451376.1/ 2823 | YP_004451373.1/ 1767 | YP_004451372.1/ 4349 | | plasmid |
| Lactobacillus casei Zhang uid50673 | 2008786 | 2025228 | YP_003789119.1/ 5007 | YP_003789118.1/ 5624 | YP_003789117.1/ 673 | YP_003789114.1/ 2828 YP_003789116.1/ 2829 | YP_003789113.1/ 1772 | YP_003789112.1/ 4351 | One complete methylase and one truncated | chromosome |
| Lactobacillus johnsonii FI9785 uid41735 | 939272 | 953168 | YP_003293166.1/ 5010 | YP_003293165.1/ 5627 | YP_003293164.1/ 676 | YP_003293163.1/ 2832 | YP_003293159.1/ 1775 | Missing | | chromosome |
| Lactobacillus reuteri SD2112 uid55357 | 1310070 | 1322351 | YP_004649803.1/ 5011 | YP_004649804.1/ 5628 | YP_004649805.1/ 677 | YP_004649806.1/ 2833 | YP_004649809.1/ 1776 | Missing | | chromosome |
| Lactobacillus rhamnosus GG uid59313 | 2154005 | 2170387 | YP_003171846.1/ 5013 | YP_003171845.1/ 5630 | YP_003171844.1/ 679 | YP_003171841.1/ 2836 YP_003171843.1/ 2837 | YP_003171840.1/ 1778 | YP_003171839.1/ 4353 | One complete methylase and one truncated. | chromosome |
| Leuconostoc kimchii IMSNU 11154 uid48589 | 34362 | 50836 | YP_003620562.1/ 5014 | YP_003620561.1/ 5631 | YP_003620560.1/ 680 | YP_003620557.1/ 2838 YP_003620559.1/ 2839 | YP_003620556.1/ 1779 | YP_003620555.1/ 4354 | One complete methylase and one truncated. | chromosome |
| Magnetospirillum magneticum AMB 1 uid58527 | 2215526 | 2231932 | YP_421401.1/ 5060 | YP_421402.1/ 5682 | YP_421403.1/ 731 YP_421406.1/ 732 | YP_421407.1/ 2912 | YP_421409.1/ 1830 | YP_421410.1/ 4398 | | chromosome |
| Marinobacter aquaeolei VT8 uid59419 | 627682 | 647741 | YP_957843.1/ 5061 | YP_957844.1/ 5683 | YP_957845.1/ 733 | YP_957849.1/ 2913 | YP_957852.1/ 1831 | YP_957853.1/ 4399 | | chromosome |
| Methanobrevibacter smithii ATCC 35061 uid58827 | 1795596 | 1818644 | YP_001274322.1/ 5015 | YP_001274323.1/ 5632 | YP_001274324.1/ 681 | YP_001274316.1/ 2840 YP_001274317.1/ 2841 YP_001274318.1/ 2842 YP_001274319.1/ 2843 YP_001274320.1/ 2844 YP_001274321.1/ 2845 | YP_001274326.1/ 1780 | YP_001274327.1/ 6165 | One complete methylase and 5 truncated. | chromosome |
| Methanosarcina acetivorans C2A uid57879 | 2919156 | 2939722 | Missing | NP_617281.1/ 5636 | NP_617280.1/ 685 | NP_617279.1/ 2852 | NP_617273.1/ 1784 | NP_617272.1/ 4358 | | chromosome |
| Methanosarcina mazei Go1 uid57893 | 193892 | 214864 | Missing | NP_632177.1/ 5637 | NP_632178.1/ 686 | NP_632180.1/ 2853 | NP_632187.1/ 1785 | NP_632188.1/ 4359 | | chromosome |

TABLE 2-continued

BREX type 1 systems

| Organism | Genomic Start Point | Genomic End Point | BrxA* | BrxB* | BrxC* | PglX* | PglZ* | BrxL* | Methylase state | Replicon Type |
|---|---|---|---|---|---|---|---|---|---|---|
| *Methanospirillum hungatei* JF 1 uid58181 | 1213818 | 1228530 | YP_502553.1/ 5017 | YP_502552.1/ 5638 | YP_502551.1/ 687 | YP_502549.1/ 2854 | YP_502546.1/ 1786 | YP_502545.1/ 4360 | | chromosome |
| *Methanospirillum hungatei* JF 1 uid58181 | 2137148 | 2153998 | Missing | YP_503327.1/ 5639 | YP_503328.1/ 688 | YP_503329.1/ 2855 | YP_503337.1/ 1787 | YP_503338.1/ 4361 | | chromosome |
| *Microlunatus phosphovorus* NM 1 uid68055 | 4106044 | 4121697 | YP_004574223.1/ 5018 | YP_004574224.1/ 5640 | YP_004574225.1/ 689 | YP_004574226.1/ 2856 YP_004574227.1/ 2857 YP_004574229.1/ 2858 | YP_004574231.1/ 1788 | YP_004574232.1/ 4362 | methylase split into three. | chromosome |
| *Moorella thermoacetica* ATCC 39073 uid58051 | 2331992 | 2347051 | YP_431074.1/ 5019 | YP_431073.1/ 5641 | YP_431072.1/ 690 | YP_431068.1/ 2854 YP_431071.1/ | YP_431067.1/ 1789 | YP_431066.1/ 4363 | Split methylase. | chromosome |
| *Nostoc punctiforme* PCC 73102 uid57767 | 6986741 | 7000722 | YP_001868910.1/ 5062 | YP_001868903.1/ 5684 | YP_001868904.1/ 734 | YP_001868905.1/ 2914 | YP_001868908.1/ 1832 | YP_001868909.1/ 4400 | | chromosome |
| *Parvularcula bermudensis* HTCC2503 uid51641 | 1068561 | 1081391 | YP_003854347.1/ 5020 | YP_003854346.1/ 5642 | YP_003854345.1/ 691 | YP_003854344.1/ 2861 | YP_003854343.1/ 1790 | YP_003854342.1/ 4364 | | chromosome |
| *Pelobacter propionicus* DSM 2379 uid58255 | 2459986 | 2475529 | YP_901956.1/ 5022 | YP_901955.1/ 5644 | YP_901954.1/ 693 | YP_901953.1/ 2864 | YP_901949.1/ 1792 | YP_901948.1/ 4366 | | chromosome |
| *Pelodictyon phaeoclathratiforme* BU 1 uid58173 | 2122302 | 2136557 | YP_002018860.1/ 5023 | YP_002018861.1/ 5645 | YP_002018862.1/ 694 | YP_002018863.1/ 2865 | YP_002018865.1/ 1793 | YP_002018866.1/ 4367 | | chromosome |
| *Photorhabdus asymbiotica* ATCC 43949 uid59243 | 470261 | 481491 | YP_003039266.1/ 5024 | YP_003039267.1/ 5646 | YP_003039268.1/ 695 | YP_003039269.1/ 2866 | YP_003039270.1/ 1794 | Missing | | chromosome |
| *Polaromonas* JS666 uid58207 | 120587 | 142415 | YP_551792.1/ 5025 | YP_551793.1/ 5647 | YP_551794.1/ 696 | YP_551797.1/ 2867 | YP_551801.1/ 1795 | YP_551802.1/ 4368 | | plasmid |
| *Pseudomonas brassicacearum* NFM421 uid66303 | 940354 | 955543 | YP_004351894.1/ 5026 | YP_004351895.1/ 5648 | YP_004351896.1/ 697 | YP_004351897.1/ 2868 | YP_004351899.1/ 1796 | YP_004351900.1/ 4369 | | chromosome |
| *Psychrobacter cryohalolentis* K5 uid58373 | 1973414 | 1984296 | YP_580872.1/ 5028 | YP_580871.1/ 5650 | YP_580870.1/ 699 | YP_580869.1/ 2871 | YP_580868.1/ 1798 | Missing | | chromosome |
| *Rhodobacter sphaeroides* ATCC 17025 uid58451 | 628478 | 642432 | YP_001169907.1/ 5063 | YP_001169906.1/ 5685 | Rsph17025_3734/ 615 | YP_001169903.1/ 2915 | YP_001169902.1/ 1833 | YP_001169901.1/ 4401 | | plasmid |
| *Rhodococcus erythropolis* PR4 uid59019 | 3099110 | 3111990 | YP_002766345.1/ 5029 | YP_002766344.1/ 5686 | YP_002766343.1/ 700 | YP_002766342.1/ 2916 | YP_002766341.1/ 1834 | YP_002766340.1/ 4371 | | chromosome |
| *Rhodopseudomonas palustris* TIE 1 uid58995 | 1186657 | 1200147 | YP_001990139.1/ 5030 | YP_001990140.1/ 5652 | YP_001990141.1/ 701 | YP_001990142.1/ 2873 | YP_001990143.1/ 1800 | YP_001990144.1/ 4372 | | chromosome |
| *Runella slithyformis* DSM 19594 uid68317 | 4922401 | 4938169 | YP_004657746.1/ 5064 | YP_004657745.1/ 5686 | YP_004657744.1/ 735 | YP_004657743.1/ 2916 | YP_004657738.1/ 1834 | YP_004657737.1/ 4402 | | chromosome |
| *Saccharophagus degradans* 2 40 uid57921 | 3482582 | 3496946 | YP_528231.1/ 5031 | YP_528230.1/ 5653 | YP_528229.1/ 702 | YP_528228.1/ 2874 | YP_528225.1/ 1801 | YP_528224.1/ 4373 | | chromosome |
| *Salmonella enterica* serovar *Typhimurium* LT2 uid57799 | 4736680 | 4751839 | NP_463357.1/ 5034 | NP_463356.1/ 5656 | NP_463355.1/ 705 | NP_463354.1/ 2877 | NP_463351.1/ 1804 | NP_463350.1/ 4376 | | chromosome |

TABLE 2-continued

BREX type 1 systems

| Organism | Genomic Start Point | Genomic End Point | BrxA* | BrxB* | BrxC* | PglX* | PglZ* | BrxL* | Methylase state | Replicon Type |
|---|---|---|---|---|---|---|---|---|---|---|
| *Selenomonas sputigena* ATCC 35185 uid66335 | 820667 | 833330 | YP_004413153.1/ 5040 | YP_004413154.1/ 5662 | YP_004413155.1/ 711 | YP_004413156.1/ 2883 | YP_004413158.1/ 1810 | Missing | | chromosome |
| *Shewanella* ANA 3 uid58347 | 2138213 | 2155059 | YP_869455.1/ 5041 | YP_869456.1/ 5663 | YP_869457.1/ 712 | YP_869458.1/ 2884 | YP_869460.1/ 1811 | Missing | | chromosome |
| *Shewanella* MR 4 uid58345 | 2013300 | 2030132 | YP_733838.1/ 5042 | YP_733839.1/ 5664 | YP_733840.1/ 713 | YP_733841.1/ 2885 | YP_733843.1/ 1812 | Missing | | chromosome |
| *Slackia heliotrinireducens* DSM 20476 uid59051 | 349611 | 366195 | YP_003142715.1/ 5043 | YP_003142714.1/ 5665 | YP_003142713.1/ 714 | YP_003142712.1/ 2886 YP_003142711.1/ 2887 | YP_003142710.1/ 1813 | YP_003142708.1/ 4382 | Two full length methylases. | chromosome |
| *Spirosoma linguale* DSM 74 uid43413 | 5893753 | 5908211 | YP_003389619.1/ 5044 | YP_003389620.1/ 5666 | YP_003389621.1/ 715 | YP_003389624.1/ 2888 | YP_003389625.1/ 1814 | YP_003389626.1/ 4383 | | chromosome |
| *Sulfuricurvum kujiense* DSM 16994 uid60789 | 1691724 | 1708882 | YP_004060547.1/ 5045 | YP_004060548.1/ 5667 | YP_004060549.1/ 716 | YP_004060550.1/ 2902 | YP_004060557.1/ 1815 | YP_004060558.1/ 4384 | Split methylase. | chromosome |
| *Syntrophomonas wolfei* Goettingen uid58179 | 2823947 | 2838578 | YP_755156.1/ 5048 | YP_755155.1/ 5670 | YP_755154.1/ 719 | YP_755151.1 YP_755153.1 | YP_755149.1/ 1815 | YP_755148.1/ 4387 | One complete methylase and one truncated. | chromosome |
| *Syntrophus wolfei* Goettingen uid58179 | 1119627 | 1137079 | YP_753673.1/ 5047 | YP_753674.1/ 5669 | YP_753675.1/ 718 | YP_753676.1/ 2893 YP_753679.1/ 2894 YP_753682.1/ 2895 | YP_753683.1/ 1817 | YP_753684.1/ 4386 | Methylase split into three. | chromosome |
| *Syntrophus aciditrophicus* SB uid58539 | 932423 | 951906 | YP_460955.1/ 5049 | YP_460954.1/ 5671 | YP_460953.1/ 720 | YP_460949.1/ 2899 | YP_460946.1/ 1819 | YP_460945.1/ 4388 | | chromosome |
| *Tepidanaerobacter* Re1 uid66873 | 564518 | 579372 | YP_004460026.1/ 5051 | YP_004460027.1/ 5673 | YP_004460028.1/ 722 | YP_004460030.1/ 2902 | YP_004460031.1/ 1821 | YP_004460032.1/ 4390 | | chromosome |
| *Thauera* MZ1T uid58987 | 329333 | 347549 | YP_002353978.1/ 5052 | YP_002353979.1/ 5674 | YP_002353980.1/ 723 | YP_002353983.1/ 2903 | YP_002353988.1/ 1822 | YP_002353989.1/ 4391 | | chromosome |
| *Thermoanaerobacterium thermosaccharolyticum* DSM 571 uid51639 | 483298 | 496318 | YP_003851149.1/ 5054 | YP_003851150.1/ 5676 | YP_003851151.1/ 725 | YP_003851152.1/ 2905 | YP_003851153.1/ 1824 | YP_003851154.1/ 4393 | | chromosome |
| *Vibrio cholerae* MJ 1236 uid59387 | 3021296 | 3036340 | YP_002879448.1/ 5057 | YP_002879447.1/ 5679 | YP_002879446.1/ 728 | YP_002879444.1/ 2909 | YP_002879443.1/ 1827 | YP_002879442.1/ 4395 | | chromosome |
| *Zymomonas mobilis* NCIMB 11163 uid41019 | 1590155 | 1602970 | YP_003226496.1/ 5059 | YP_003226497.1/ 5681 | YP_003226498.1/ 730 | YP_003226499.1/ 2911 | YP_003226500.1/ 1829 | YP_003226501.1/ 4397 | | chromosome |
| *Thioalkalivibrio* sp. K90mix | 1195163 | 1212198 | YP_003460374.1/ 6225 | YP_003460375.1/ 6227 | TK90_1129 (no accession)/ 6229 | YP_003460378.1/ 6231 | YP_003460381.1/ 6233 | YP_003460382.1/ 6235 | | chromosome |

*Numbers are presented by Accession NO./SEQ ID NO.

TABLE 3

BREX type 5 systems

| Organism | Genomic Start Point | Genomic End Point | BrxA* | BrxB* | BrxC/PglY* | PglX* |
|---|---|---|---|---|---|---|
| Haloarcula hispanica ATCC 33960 uid72475 | 401474 | 426563 | YP_004786064.1/ 5068 | YP_004786062.1/ 5691 | YP_004786061.1/ 744<br>YP_004786063.1/ 745 | YP_004786055.1/ 2922<br>YP_004786058.1/ 2923 |
| Halobacterium salinarum R1 uid61571 | 213889 | 239329 | YP_001690762.1/ 5066 | YP_001690760.1/ 5689 | YP_001690761.1/ 741<br>YP_001690759.1/ 740 | YP_001690755.1/ 2919 |
| halophilic archaeon DL31 uid72619 | 245839 | 265731 | YP_004809887.1/ 5069 | YP_004809889.1/ 5692 | YP_004809888.1/ 746<br>YP_004809890.1/ 747 | YP_004809893.1/ 2924 |
| Halopiger xanaduensis SH 6 uid68105 | 275443 | 305939 | YP_004595482.1/ 5065 | YP_004595484.1/ 5687 | YP_004595483.1/ 736<br>YP_004595485.1/ 737 | YP_004595494.1/ 2917 |
| Halorubrum lacusprofundi ATCC 49239 uid58807 | 421884 | 442192 | YP_002564617.1/ 5067 | YP_002564615.1/ 5690 | YP_002564616.1/ 743<br>YP_002564614.1/ 742 | YP_002564611.1/ 2920 |
| Halorhabdus utahensis DSM 12940 uid59189 | 1919731 | 1943689 | 257052977/ 6171 | YP_003130812.1/ 5688 | YP_003130811.1/ 738<br>YP_003130813.1/ 739 | YP_003130818.1/ 2918 |

| Organism | PglZ* | BrxHII* | Methylase State | Replicon Type |
|---|---|---|---|---|
| Haloarcula hispanica ATCC 33960 uid72475 | YP_004786056.1/ 1839 | YP_004786054.1/ 3501 | Two full length methylases. | chromosome |
| Halobacterium salinarum R1 uid61571 | YP_001690753.1/ 1837 | | | plasmid |
| halophilic archaeon DL31 uid72619 | YP_004809895.1/ 1840 | YP_004809896.1/ 3502 | | plasmid |
| Halopiger xanaduensis SH 6 uid68105 | YP_004595497.1/ 1835 | YP_004595499.1/ 3498 | | chromosome |
| Halorubrum lacusprofundi ATCC 49239 uid58807 | YP_002564610.1/ 1838 | YP_002564609.1/ 3500 | | chromosome |
| Halorhabdus utahensis DSM 12940 uid59189 | YP_003130820.1/ 1836 | YP_003130822.1/ 3499 | | chromosome |

*Numbers are presented by Accession NO./SEQ ID NO.

TABLE 4

BREX type 6 systems

| Organism | Genomic Start Point | Genomic End Point | BrxE* | BrxA* | BrxB* | BrxC/PglY* |
|---|---|---|---|---|---|---|
| Anaeromyxobacter dehalogenans 2CP 1 uid58989 | 1284321 | 1301040 | YP_002491563.1/ 6038 | YP_002491564.1/ 5072 | YP_002491565.1/ 5695 | YP_002491566.1/ 751 |
| Haliangium ochraceum DSM 14365 uid41425 | 1611313 | 1628687 | YP_003265686.1/ 6040 | YP_003265687.1/ 5074 | YP_003265688.1/ 5697 | YP_003265689.1/ 753 |
| Haliangium ochraceum DSM 14365 uid41425 | 798493 | 815906 | YP_003265127.1/ 6039 | YP_003265128.1/ 5073 | YP_003265129.1/ 5696 | YP_003265130.1/ 752 |

TABLE 4-continued

| BREX type 6 systems | | | | | | |
|---|---|---|---|---|---|---|
| *Planctomyces limnophilus* DSM 3776 uid48643 | 3979304 | 3995634 | YP_003631101.1/ 6037 | YP_003631100.1/ 5071 | YP_003631099.1/ 5694 | YP_003631098.1/ 750 |

| Organism | PglX* | PglZ* | BrxD* | BrxHI* |
|---|---|---|---|---|
| *Anaeromyxobacter dehalogenans* 2CP 1 uid58989 | YP_002491567.1/ 2928 | YP_002491568.1/ 1843 | YP_002491570.1/ 4442 | YP_002491571.1/ 3623 |
| *Haliangium ochraceum* DSM 14365 uid41425 | YP_003265690.1/ 2930 | YP_003265691.1/ 1845 | YP_003265692.1/ 4444 | YP_003265693.1/ 3625 |
| *Haliangium ochraceum* DSM 14365 uid41425 | YP_003265131.1/ 2929 | YP_003265132.1/ 1844 | YP_003265133.1/ 4443 | YP_003265134.1/ 3624 |
| *Planctomyces limnophilus* DSM 3776 uid48643 | YP_003631097.1/ 2927 | YP_003631096.1/ 1842 | YP_003631095.1/ 4441 | YP_003631094.1/ 3622 |

*Numbers are presented by Accession NO./SEQ ID NO.

TABLE 5

| Organism | Genomic Start Point | Genomic End Point | BrxF* | BrxC/PglY* | PglXI* | BrxHII* | PglZ* | BrxA* |
|---|---|---|---|---|---|---|---|---|
| Acidothermus cellulolyticus 11B uid58501 | 895934 | 911157 | YP_872570.1/ 5980 | YP_872571.1/ 755 | YP_872573.1/ 3344 | YP_872575.1/ 3504 | YP_872576.1/ 1847 | YP_872577.1/ 5076 |
| Parvibaculum lavamentivorans DS 1 uid58739 | 1304574 | 1320948 | YP_001412459.1/ 5992 | YP_001412458.1/ 769 | YP_001412455.1/ 3360 | YP_001412454.1/ 3515 | YP_001412453.1/ 1860 | YP_001412452.1/ 5089 |
| Parvibaculum lavamentivorans DS 1 uid58739 | 3796620 | 3812997 | YP_001414809.1/ 5993 | YP_001414810.1/ 770 | YP_001414813.1/ 3361 | YP_001414814.1/ 3516 | YP_001414815.1/ 1861 | YP_001414816.1/ 5090 |
| Chloroflexus aggregans DSM 9485 uid58621 | 1376256 | 1391910 | YP_002462464.1/ 5983 | YP_002462466.1/ 759 | YP_002462465.1/ 3348 | YP_002462469.1/ 3507 | YP_002462470.1/ 1851 | YP_002462471.1/ 5080 |
| Desulfovibrio aespoeensis Aspo 2 uid42613 | 1822100 | 1838149 | YP_004121411.1/ 5984 | YP_004121412.1/ 760 | YP_004121414.1/ 3350 | YP_004121416.1/ 3508 | YP_004121417.1/ 1852 | YP_004121418.1/ 5081 |
| Methanosalsum zhilinae DSM 4017 uid68249 | 1398870 | 1421705 | YP_004616377.1/ 5987 | YP_004616376.1/ 764 | YP_004616375.1/ 3353 | YP_004616371.1/ 3510 | YP_004616370.1/ 1855 | YP_004616369.1/ 5084 |
| Caldicellulosiruptor kristjanssonii 177R1B uid60393 | 671655 | 683698 | YP_004025779.1/ 5982 | YP_004025780.1/ 758 | YP_004025781.1/ 3347 | Calkr_0625/ 6173 | YP_004025782.1/ 1850 | YP_004025783.1/ 5079 |
| Pelotomaculum thermopropionicum SI uid58877 | 698030 | 719373 | | YP_001211256.1/ 616 | YP_001211265.1/ 3403 | YP_001211266.1/ 3493 | YP_001211267.1/ 1715 | / |
| Thermoanaerobacter brockii finnii Ako 1 uid55639 | 974096 | 986151 | YP_004185913.1/ 5999 | YP_004185914.1/ 777 | YP_004185915.1/ 3367 | YP_004185916.1/ 3519 | YP_004185917.1/ 1867 | YP_004185918.1/ 5096 |
| Thermoanaerobacter pseudethanolicus ATCC 33223 uid58339 | 981903 | 993958 | YP_001664916.1/ 6001 | YP_001664917.1/ 779 | YP_001664918.1/ 3369 | YP_001664919.1/ 3520 | YP_001664920.1/ 1869 | YP_001664921.1/ 5098 |
| Thermoanaerobacterium xylanolyticum LX 11 uid63163 | 1036830 | 1048931 | YP_004470679.1/ 6004 | YP_004470680.1/ 782 | YP_004470681.1/ 3372 | YP_004470682.1/ 3523 | YP_004470683.1/ 1872 | YP_004470684.1/ 5101 |
| Thermoanaerobacter italicus Ab9 uid46241 | 1369768 | 1379419 | YP_003477173.1/ 6000 | YP_003477172.1/ 778 | YP_003477171.1/ 3368 | Missing | YP_003477169.1/ 1868 | YP_003477168.1/ 5097 |

TABLE 5-continued

BREX type 3 systems

| Organism | Genomic Start Point | Genomic End Point | BrxF* | BrxC/PglY* | PglXI* | BrxHII* | PglZ* | BrxA* |
|---|---|---|---|---|---|---|---|---|
| Syntrophothermus lipocalidus DSM 12680 uid49527 | 1307417 | 1316966 | YP_003702612.1/ 5995 | YP_003702611.1/ 772 | YP_003702610.1/ 3363 | Missing | YP_003702609.1/ 1863 | YP_003702608.1/ 5092 |
| Acetohalobium arabaticum DSM 5501 uid51423 | 1465881 | 1481230 | YP_003827965.1/ 5979 | YP_003827964.1/ 754 | YP_003827963.1/ 3343 | Missing | YP_003827962.1/ 1846 | YP_003827961.1/ 5075 |
| Dichelobacter nodosus VCS1703A uid57643 | 185804 | 200163 | YP_001209111.1/ 5985 | YP_001209110.1/ 761 | YP_001209109.1/ 3351 | YP_001209106.1/ 3509 | YP_001209105.1/ 1853 | YP_001209104.1/ 5082 |
| Nitrosococcus oceani ATCC 19707 uid58403 | 53559 | 70307 | YP_342127.1/ 5990 | YP_342128.1/ 767 | YP_342131.1/ 3358 | YP_342135.1/ 3513 | YP_342136.1/ 1858 | YP_342137.1/ 5087 |
| Nitrosococcus watsonii C 113 uid50331 | 43703 | 58760 | YP_003759356.1/ 5991 | YP_003759357.1/ 768 | YP_003759359.1/ 3359 | YP_003759363.1/ 3514 | YP_003759364.1/ 1859 | YP_003759365.1/ 5088 |
| Methylacidiphilum infernorum V4 uid59161 | 317802 | 333912 | YP_001938984.1/ 5988 | YP_001938983.1/ 765 | YP_001938982.1/ 3356 | YP_001938980.1/ 3511 | YP_001938979.1/ 1856 | YP_001938978.1/ 5085 |
| Thermanaerovibrio acidaminovorans DSM 6589 uid41925 | 1551826 | 1568220 | YP_003318004.1/ 5998 | YP_003318003.1/ 776 | YP_003318001.1/ 3366 | YP_003317999.1/ 3518 | YP_003317998.1/ 1866 | YP_003317997.1/ 5095 |
| Planctomyces brasiliensis DSM 5305 uid60583 | 1319343 | 1335543 | YP_004268781.1/ 5994 | YP_004268780.1/ 771 | YP_004268778.1/ 3362 | YP_004268777.1/ 3517 | YP_004268776.1/ 1862 | YP_004268775.1/ 5091 |
| Tepidanaerobacter Re1 uid66873 | 1934428 | 1943118 | YP_004461309.1/ 5997 | YP_004461308.1/ 775 | YP_004461307.1/ 3365 | missing | YP_004461306.1/ 1865 | YP_004461305.1/ 5096 |

*Numbers are presented by Accession NO./SEQ ID NO.

TABLE 6

| Organism | Genomic Start Point | Genomic End Point | BREX type 2 systems | | | | | |
|---|---|---|---|---|---|---|---|---|
| | | | PglW* | PglX* | PglY* | PglZ* | BrxD* | BrxHI* |
| Candidatus Accumulibacter phosphatis clade IIA UW 1 uid59207 | 3869550 | 3890263 | YP_003168573.1/ 6092 | YP_003168572.1/ 2932 | YP_003168567.1/ 784 | YP_003168566.1/ 1874 | YP_003168565.1/ 4445 | YP_003168564.1/ 3596 |
| Corynebacterium variabile DSM 44702 uid62003 | 1913373 | 1933608 | YP_004760098.1/ 6094 | YP_004760099.1/ 2934 | YP_004760100.1/ 787 | YP_004760101.1/ 1876 | YP_004760102.1/ 4446 | YP_004760103.1/ 3598 |
| Frankia CcI3 uid58397 | 3489708 | 3507585 | YP_482039.1/ 6095 | YP_482040.1/ 2935 | YP_482041.1/ 788 | YP_482042.1/ 1877 | YP_482043.1/ 4447 | YP_482044.1/ 3599 |
| Frankia EuI1c uid42615 | 6951904 | 6971263 | YP_004019519.1/ 6096 | YP_004019520.1/ 2936 | YP_004019521.1/ 789 | YP_004019522.1/ 1878 | YP_004019523.1/ 4448 | YP_004019524.1/ 3600 |
| Hahella chejuensis KCTC 2396 uid58483 | 3587257 | 3606877 | YP_434642.1/ 6114 | YP_434639.1/ 2953 | YP_434638.1/ 806 | YP_434637.1/ 1894 | YP_434636.1/ 4462 | YP_434635.1/ 3615 |
| Haliangium ochraceum DSM 14365 uid41425 | 1565170 | 1582937 | YP_003265661.1/ 6097 | YP_003265662.1/ 2937 | YP_003265663.1/ 790 | YP_003265664.1/ 1879 | YP_003265665.1/ 791 | YP_003265666.1/ 3601 |
| Microlunatus phosphovorus NM 1 uid68055 | 3075705 | 3093432 | YP_004573280.1/ 6098 | YP_004573279.1/ 2938 | YP_004573278.1/ 792 | YP_004573277.1/ 1880 | YP_004573276.1/ 4449 | YP_004573275.1/ 3602 |
| Micromonospora aurantiaca ATCC 27029 uid42501 | 1329830 | 1350410 | YP_003834429.1/ 6099 | YP_003834430.1/ 2939 | YP_003834433.1/ 793 | YP_003834434.1/ 1881 | YP_003834435.1/ 4450 | YP_003834436.1/ 3603 |
| Mycobacterium gilvum PYR GCK uid59421 | 3386977 | 3404461 | YP_0011344469.1/ 6100 | YP_001134468.1/ 2940 | YP_001134467.1/ 794 | YP_001134466.1/ 1882 | YP_001134465.1/ 4451 | YP_001134464.1/ 3604 |
| Polaromonas naphthalenivorans CJ2 uid58273 | 170793 | 191771 | YP_973309.1/ 6102 | YP_973307.1/ 2942 | YP_973304.1/ 796 | YP_973303.1/ 1884 | YP_973302.1/ 4453 | YP_973301.1/ 3606 |

TABLE 6-continued

| Organism | Genomic Start Point | Genomic End Point | PglW* | PglX* | PglY* | PglZ* | BrxD* | BrxHI* |
|---|---|---|---|---|---|---|---|---|
| Saccharopolyspora erythraea NRRL 2338 uid62947 | 5714083 | 5716377 | YP_001107302.1/ 6104 | YP_001107301.1/ 2945 | YP_001107300.1/ 798 | YP_001107299.1/ 1886 | YP_001107298.1/ 4455 | YP_001107297.1/ 3608 |
| Sorangium cellulosum So ce 56 uid61629 | 1.10E+07 | 10706714 | YP_001618324.1/ 6107 | YP_001618325.1/ 2948 | YP_001618331.1/ 801 | YP_001618334.1/ 1889 | YP_001618335.1/ 4458 | YP_001618336.1/ 3611 |
| Streptomyces coelicolor A3 2 uid57801 | 7348537 | 7376403 | NP_630703.1/ 6110 | NP_733709.1/ 2949 | NP_630711.1/ 802 | NP_630712.1/ 1890 | NP_630715.1/ 4459 | NP_630716.1/ 3612 |
| Streptomyces griseus NBRC 13350 uid58983 | 1877109 | 1900853 | YP_001823112.1/ 6111 | YP_001823113.1/ 2950 | YP_001823118.1/ 803 | YP_001823119.1/ 1891 | YP_001823122.1/ 4460 | YP_001823123.1/ 3613 |
| Thermobifida fusca YX uid57703 | 810381 | 830646 | YP_288762.1/ 6112 | Rsph17025_3734/ 615 | YP_288770.1/ 804 | YP_288771.1/ 1892 | YP_288772.1/ 4461 | YP_288773.1/ 3614 |
| Burkholderia thailandensis E264 uid58081 | 131918 | 145741 | YP_440673.1/ 6091 | YP_440674.1/ 2931 | YP_440675.1/ 783 | YP_440676.1/ 1873 | Missing | Missing |
| Thermobispora bispora DSM 43833 uid48999 | 1764882 | 779583 | YP_003652152.1/ 6113 | YP_003652153.1/ 2952 | YP_003652154.1/ 805 | YP_003652155.1/ 1893 | Missing | Missing |
| Saccharomonospora viridis DSM 43017 | 508003 | 530821 | YP_003132413.1/ 6103 | YP_003132422.1/ 2944 | YP_003132423.1/ 797 | YP_003132424.1/ 1885 | YP_003132425.1/ 4454 | YP_003132426.1/ 3607 |

*Numbers are presented by Accession NO./SEQ ID NO.

TABLE 7

BREX type 4 systems

| Organism | Genomic Start Point | Genomic End Point | BrxP* | BrxC/PglY* | PglZ* | BrxL* |
|---|---|---|---|---|---|---|
| Candidatus Desulforudis audaxviator MP104C uid59067 | 837185 | 848109 | YP_001716949.1/ 3431 | YP_001716950.1/ 809 | YP_001716952.1/ 1897 | YP_001716953.1/ 4405 |
| Coprothermobacter proteolyticus DSM 5265 uid59253 | 1373789 | 1384972 | YP_002247820.1/ 3433 YP_002247819.1/ 3432 | YP_002247818.1/ 810 | YP_002247817.1/ 1898 | YP_002247816.1/ 4406 |
| Denitrovibrio acetiphilus DSM 12809 uid46657 | 583467 | 593589 | YP_003503325.1/ 3435 | YP_003503326.1/ 813 | YP_003503327.1/ 1900 | YP_003503328.1/ 4408 |
| Geobacter M21 uid59037 | 937933 | 948070 | YP_003020622.1/ 3437 | YP_003020623.1/ 815 | YP_003020624.1/ 1902 | YP_003020625.1/ 4410 |
| Prevotella denticola F0289 uid65091 | 414128 | 424371 | YP_004328097.1/ 3438 | YP_004328099.1/ 816 | YP_004328100.1/ 1903 | YP_004328101.1/ 4411 |
| Thermomicrobium roseum DSM 5159 uid59341 | 91162 | 104624 | | YP_002523385.1/ 614 | YP_002523389.1/ 1714 | YP_002523390.1/ 4299 |
| Thermotoga petrophila RKU 1 uid58655 | 1747153 | 1756730 | YP_001245328.1/ 3439 | YP_001245329.1/ 817 | YP_001245330.1/ 1904 | YP_001245331.1/ 4412 |

*Numbers are presented by Accession NO./SEQ ID NO.

TABLE 8

Summary of distribution of BREX types across genomes

| | Taxon ID | Organism | Kingdom | BREX #1 | BREX #5 | BREX #6 | BREX #3 | BREX #2 | BREX #4 | Comments |
|---|---|---|---|---|---|---|---|---|---|---|
| 1 | 882 | Desulfovibrio vulgaris Hildenborough uid57645 | Bacteria | X | | | | | | |
| 2 | 56780 | Syntrophus aciditrophicus SB uid58539 | Bacteria | X | | | | | | |
| 3 | 60480 | Shewanella MR 4 uid58345 | Bacteria | X | | | | | | |
| 4 | 62140 | Acidiphilium multivorum AIU301 uid63345 | Bacteria | X | | | | | | |
| 5 | 63737 | Nostoc punctiforme PCC 73102 uid57767 | Bacteria | X | | | | | | |
| 6 | 76114 | Aromatoleum aromaticum EbN1 uid58231 | Bacteria | X | | | | | | |
| 7 | 85643 | Thauera MZ1T uid58987 | Bacteria | X | | | | | | |
| 8 | 94122 | Shewanella ANA 3 uid58347 | Bacteria | X | | | | | | |
| 9 | 99287 | Salmonella enterica serovar Typhimurium LT2 uid57799 | Bacteria | X | | | | | | |
| 10 | 138119 | Desulfitobacterium hafniense Y51 uid58605 | Bacteria | X | | | | | | |
| 11 | 188937 | Methanosarcina acetivorans C2A uid57879 | Archaea | X | | | | | | |
| 12 | 192952 | Methanosarcina mazei Go1 uid57893 | Archaea | X | | | | | | |
| 13 | 203122 | Saccharophagus degradans 2 40 uid57921 | Bacteria | X | | | | | | |
| 14 | 234621 | Rhodococcus erythropolis PR4 uid59019 | Bacteria | X | | | | | | |
| 15 | 243231 | Geobacter sulfurreducens PCA uid57743 | Bacteria | X | | | | | | |
| 16 | 246194 | Carboxydothermus hydrogenoformans Z 2901 uid57821 | Bacteria | X | | | | | | |
| 17 | 262543 | Exiguobacterium sibiricum 255 15 uid58053 | Bacteria | X | | | | | | |
| 18 | 264732 | Moorella thermoacetica ATCC 39073 uid58051 | Bacteria | X | | | | | | |
| 19 | 269482 | Burkholderia vietnamiensis G4 uid58075 | Bacteria | X | | | | | | |

TABLE 8-continued

Summary of distribution of BREX types across genomes

| | Taxon ID | Organism | Kingdom | BREX #1 | BREX #5 | BREX #6 | BREX #3 | BREX #2 | BREX #4 | Comments |
|---|---|---|---|---|---|---|---|---|---|---|
| 20 | 290397 | *Anaeromyxobacter dehalogenans* 2CP C uid58135 | Bacteria | X | | | | | | |
| 21 | 296591 | *Polaromonas* JS666 uid58207 | Bacteria | X | | | | | | |
| 22 | 311424 | *Dehalococcoides* VS uid42393 | Bacteria | X | | | | | | |
| 23 | 314225 | *Erythrobacter litoralis* HTCC2594 uid58299 | Bacteria | X | | | | | | |
| 24 | 314260 | *Parvularcula bermudensis* HTCC2503 uid51641 | Bacteria | X | | | | | | |
| 25 | 323259 | *Methanospirillum hungatei* JF 1 uid58181 | Archaea | XX | | | | | | This genome contains two BREX systems of type 1 |
| 26 | 324925 | *Pelodictyon phaeoclathratiforme* BU 1 uid58173 | Bacteria | X | | | | | | |
| 27 | 331112 | *Escherichia coli* HS uid58393 | Bacteria | X | | | | | | |
| 28 | 331678 | *Chlorobium phaeobacteroides* BS1 uid58131 | Bacteria | X | | | | | | |
| 29 | 335284 | *Psychrobacter cryohalolentis* K5 uid58373 | Bacteria | X | | | | | | |
| 30 | 335541 | *Syntrophomonas wolfei* Goettingen uid58179 | Bacteria | XX | | | | | | This genome contains two BREX systems of type 1 |
| 31 | 338966 | *Pelobacter propionicus* DSM 2379 uid58255 | Bacteria | X | | | | | | |
| 32 | 342108 | *Magnetospirillum magneticum* AMB 1 uid58527 | Bacteria | X | | | | | | |
| 33 | 349102 | *Rhodobacter sphaeroides* ATCC 17025 uid58451 | Bacteria | X | | | | | | |
| 34 | 351348 | *Marinobacter aquaeolei* VT8 uid59419 | Bacteria | X | | | | | | |
| 35 | 395494 | *Gallionella capsiferriformans* ES 2 uid51505 | Bacteria | XX | | | | | | This genome contains two BREX systems of type 1 |
| 36 | 395960 | *Rhodopseudomonas palustris* TIE 1 uid58995 | Bacteria | X | | | | | | |
| 37 | 395962 | *Cyanothece* PCC 8802 uid59143 | Bacteria | X | | | | | | |
| 38 | 420247 | *Methanobrevibacter smithii* ATCC 35061 uid58827 | Archaea | X | | | | | | |
| 39 | 471223 | *Geobacillus* WCH70 uid59045 | Bacteria | X | | | | | | |
| 40 | 471855 | *Slackia heliotrinireducens* DSM 20476 uid59051 | Bacteria | X | | | | | | |
| 41 | 491077 | *Lactobacillus reuteri* SD2112 uid55357 | Bacteria | X | | | | | | |
| 42 | 498216 | *Lactobacillus casei* Zhang uid50673 | Bacteria | X | | | | | | |
| 43 | 499177 | *Clostridium sticklandii* DSM 519 uid59585 | Bacteria | X | | | | | | |
| 44 | 504472 | *Spirosoma linguale* DSM 74 uid43413 | Bacteria | X | | | | | | |
| 45 | 509173 | *Acinetobacter baumannii* AYE uid61637 | Bacteria | X | | | | | | |
| 46 | 525897 | *Desulfomicrobium baculatum* DSM 4028 uid59217 | Bacteria | X | | | | | | |
| 47 | 546271 | *Selenomonas sputigena* ATCC 35185 uid66335 | Bacteria | X | | | | | | |
| 48 | 552811 | *Dehalogenimonas lykanthroporepellens* BL DC 9 uid48131 | Bacteria | X | | | | | | |
| 49 | 553480 | *Photorhabdus asymbiotica* ATCC 43949 uid59243 | Bacteria | X | | | | | | |
| 50 | 568703 | *Lactobacillus rhamnosus* GG uid59313 | Bacteria | X | | | | | | |
| 51 | 573370 | *Desulfovibrio magneticus* RS 1 uid59309 | Bacteria | X | | | | | | |

TABLE 8-continued

Summary of distribution of BREX types across genomes

| | Taxon ID | Organism | Kingdom | BREX #1 | BREX #5 | BREX #6 | BREX #3 | BREX #2 | BREX #4 | Comments |
|---|---|---|---|---|---|---|---|---|---|---|
| 52 | 580327 | Thermoanaerobacterium thermosaccharolyticum DSM 571 uid51639 | Bacteria | X | | | | | | |
| 53 | 585054 | Escherichia fergusonii ATCC 35469 uid59375 | Bacteria | X | | | | | | |
| 54 | 585396 | Escherichia coli O111 H 11128 uid41023 | Bacteria | X | | | | | | |
| 55 | 589865 | Desulfurivibrio alkaliphilus AHT2 uid49487 | Bacteria | X | | | | | | |
| 56 | 593588 | Vibrio cholerae MJ 1236 uid59387 | Bacteria | X | | | | | | |
| 57 | 610130 | Clostridium saccharolyticum WM1 uid51419 | Bacteria | XX | | | | | | This genome contains two BREX systems of type 1 |
| 58 | 622759 | Zymomonas mobilis NCIMB 11163 uid41019 | Bacteria | X | | | | | | |
| 59 | 633699 | Lactobacillus johnsonii FI9785 uid41735 | Bacteria | X | | | | | | |
| 60 | 634499 | Erwinia pyrifoliae Ep1 96 uid40659 | Bacteria | X | | | | | | |
| 61 | 640510 | Burkholderia CCGE1001 uid42975 | Bacteria | X | | | | | | |
| 62 | 709032 | Sulfuricurvum kujiense DSM 16994 uid60789 | Bacteria | X | | | | | | |
| 63 | 743299 | Acidithiobacillus ferrivorans SS3 uid67387 | Bacteria | X | | | | | | |
| 64 | 748727 | Clostridium ljungdahlii DSM 13528 uid50583 | Bacteria | X | | | | | | |
| 65 | 760192 | Haliscomenobacter hydrossis DSM 1100 uid66777 | Bacteria | X | | | | | | |
| 66 | 761193 | Runella slithyformis DSM 19594 uid68317 | Bacteria | X | | | | | | |
| 67 | 762051 | Leuconostoc kimchii IMSNU 11154 uid48589 | Bacteria | X | | | | | | |
| 68 | 768670 | Calditerrivibrio nitroreducens DSM 19672 uid60821 | Bacteria | X | | | | | | |
| 69 | 994484 | Pseudomonas brassicacearum NFM421 uid66303 | Bacteria | X | | | | | | |
| 70 | 999541 | Burkholderia gladioli BSR3 uid66301 | Bacteria | X | | | | | | |
| 71 | 1032480 | Microlunatus phosphovorus NM 1 uid68055 | Bacteria | X | | | | X | | This genome contains two BREX systems (types 1 and 2) |
| 72 | 1042156 | Clostridium SY8519 uid68705 | Bacteria | X | | | | | | |
| 73 | 1042878 | Cupriavidus necator N 1 uid68689 | Bacteria | X | | | | | | |
| 74 | 1209989 | Tepidanaerobacter Re1 uid66873 | Bacteria | X | | | X | | | This genome contains two BREX systems (types 1 and 3) |
| 75 | 416348 | Halorubrum lacusprofundi ATCC 49239 uid58807 | Archaea | | X | | | | | |
| 76 | 478009 | Halobacterium salinarum R1 uid61571 | Archaea | | X | | | | | |
| 77 | 519442 | Halorhabdus utahensis DSM 12940 uid59189 | Archaea | | X | | | | | |
| 78 | 634497 | Haloarcula hispanica ATCC 33960 uid72475 | Archaea | | X | | | | | |
| 79 | 756883 | halophilic archaeon DL31 uid72619 | Archaea | | X | | | | | |
| 80 | 797210 | Halopiger xanaduensis SH 6 uid68105 | Archaea | | X | | | | | |
| 81 | 455488 | Anaeromyxobacter dehalogenaris 2CP 1 uid58989 | Bacteria | | | X | | | | |
| 82 | 502025 | Haliangium ochraceum DSM 14365 uid41425 | Bacteria | | | XX | | X | | This genome contains three BREX systems (two types 6 and one of type 2) |
| 83 | 521674 | Planctomyces limnophilus DSM 3776 uid48643 | Bacteria | | | X | | | | |

TABLE 8-continued

Summary of distribution of BREX types across genomes

| | Taxon ID | Organism | Kingdom | BREX #1 | BREX #5 | BREX #6 | BREX #3 | BREX #2 | BREX #4 | Comments |
|---|---|---|---|---|---|---|---|---|---|---|
| 84 | 105559 | *Nitrosococcus watsonii* C 113 uid50331 | Bacteria | | | | X | | | |
| 85 | 246195 | *Dichelobacter nodosus* VCS1703A uid57643 | Bacteria | | | | X | | | |
| 86 | 323261 | *Nitrosococcus oceani* ATCC 19707 uid58403 | Bacteria | | | | X | | | |
| 87 | 326427 | *Chloroflexus aggregans* DSM 9485 uid58621 | Bacteria | | | | X | | | |
| 88 | 340099 | *Thermoanaerobacter pseudethanolicus* ATCC 33223 uid58339 | Bacteria | | | | X | | | |
| 89 | 351607 | *Acidothermus cellulolyticus* 11B uid58501 | Bacteria | | | | X | | | |
| 90 | 370438 | *Pelotomaculum thermopropionicum* SI uid58877 | Bacteria | | | | X | | | |
| 91 | 402881 | *Parvibaculum lavamentivorans* DS 1 uid58739 | Bacteria | | | | XX | | | This genome contains two BREX systems of type 3 |
| 92 | 481448 | *Methylacidiphilum infernorum* V4 uid59161 | Bacteria | | | | X | | | |
| 93 | 509193 | *Thermoanaerobacter brockii finnii* Ako 1 uid55639 | Bacteria | | | | X | | | |
| 94 | 525903 | *Thermanaerovibrio acidaminovorans* DSM 6589 uid41925 | Bacteria | | | | X | | | |
| 95 | 574087 | *Acetohalobium arabaticum* DSM 5501 uid51423 | Bacteria | | | | X | | | |
| 96 | 580331 | *Thermoanaerobacter italicus* Ab9 uid46241 | Bacteria | | | | X | | | |
| 97 | 632335 | *Caldicellulosiruptor kristjanssonii* 177R1B uid60393 | Bacteria | | | | X | | | |
| 98 | 643562 | *Desulfovibrio aespoeensis* Aspo 2 uid42613 | Bacteria | | | | X | | | |
| 99 | 643648 | *Syntrophothermus lipocalidus* DSM 12680 uid49527 | Bacteria | | | | X | | | |
| 100 | 679901 | *Methanosalsum zhilinae* DSM 4017 uid68249 | Archaea | | | | X | | | |
| 101 | 756272 | *Planctomyces brasiliensis* DSM 5305 uid60583 | Bacteria | | | | X | | | |
| 102 | 858215 | *Thermoanaerobacterium xylanolyticum* LX 11 uid63163 | Bacteria | | | | X | | | |
| 103 | 100226 | *Streptomyces coelicolor* A3 2 uid57801 | Bacteria | | | | | X | | |
| 104 | 106370 | *Frankia* CcI3 uid58397 | Bacteria | | | | | X | | |
| 105 | 269800 | *Thermobifida fusca* YX uid57703 | Bacteria | | | | | X | | |
| 106 | 271848 | *Burkholderia thailandensis* E264 uid58081 | Bacteria | | | | | X | | |
| 107 | 298654 | *Frankia* EuI1c uid42615 | Bacteria | | | | | X | | |
| 108 | 349521 | *Hahella chejuensis* KCTC 2396 uid58483 | Bacteria | | | | | X | | |
| 109 | 350054 | *Mycobacterium gilvum* PYR GCK uid59421 | Bacteria | | | | | X | | |
| 110 | 365044 | *Polaromonas naphthalenivorans* CJ2 uid58273 | Bacteria | | | | | X | | |
| 111 | 405948 | *Saccharopolyspora erythraea* NRRL 2338 uid62947 | Bacteria | | | | | X | | |
| 112 | 448385 | *Sorangium cellulosum* So ce 56 uid61629 | Bacteria | | | | | X | | |
| 113 | 455632 | *Streptomyces griseus* NBRC 13350 uid58983 | Bacteria | | | | | X | | |
| 114 | 469371 | *Thermobispora bispora* DSM 43833 uid48999 | Bacteria | | | | | X | | |
| 115 | 522306 | *Candidatus Accumulibacter phosphatis* clade IIA UW 1 uid59207 | Bacteria | | | | | X | | |
| 116 | 644283 | *Micromonospora aurantiaca* ATCC 27029 uid42501 | Bacteria | | | | | X | | |

TABLE 8-continued

Summary of distribution of BREX types across genomes

| | Taxon ID | Organism | Kingdom | BREX #1 | BREX #5 | BREX #6 | BREX #3 | BREX #2 | BREX #4 | Comments |
|---|---|---|---|---|---|---|---|---|---|---|
| 117 | 858619 | *Corynebacterium variabile* DSM 44702 uid62003 | Bacteria | | | | | X | | |
| 118 | 309798 | *Coprothermobacter proteolyticus* DSM 5265 uid59253 | Bacteria | | | | | | X | |
| 119 | 309801 | *Thermomicrobium roseum* DSM 5159 uid59341 | Bacteria | | | | | | X | |
| 120 | 390874 | *Thermotoga petrophila* RKU 1 uid58655 | Bacteria | | | | | | X | |
| 121 | 443144 | *Geobacter* M21 uid59037 | Bacteria | | | | | | X | |
| 122 | 477974 | *Candidatus Desulforudis audaxviator* MP104C uid59067 | Bacteria | | | | | | X | |
| 123 | 522772 | *Denitrovibrio acetiphilus* DSM 12809 uid46657 | Bacteria | | | | | | X | |
| 124 | 767031 | *Prevotella denticola* F0289 uid65091 | Bacteria | | | | | | X | |
| 125 | 396595 | *Thioalkalivibrio* sp. K90mix | Bacteria | X | | | | | | |
| 126 | 471857 | *Saccharomonospora viridis* DSM 43017 | Bacteria | | | | | X | | |

TABLE 10

| Organism | Genomic Start Point | Genomic End Point | brxA* | brxB* | brxC* | pglX* | pglZ* | brxL* |
|---|---|---|---|---|---|---|---|---|
| Acidiphilium multivorum AIU301 uid63345 | 497516 | 512043 | 326402595/ 4953 | 326402594/ 5570 | 326402593/ 617 | 326402591/ 2766 326402592/ 2767 | 326402589/ 1716 | 326402588/ 4300 |
| Acidithiobacillus ferrivorans SS3 uid67387 | 2361379 | 2377751 | 344200465/ 4954 | 344200466/ 5571 | 344200467/ 618 | 344200468/ 2768 344200470/ 2769 | 344200473/ 1717 | 344200474/ 4301 |
| Acinetobacter baumannii AYE uid61637 | 53839 | 68427 | 169786944/ 4955 | 169786943/ 5572 | 169786942/ 619 | 169786941/ 2770 | 169786939/ 1718 | 169786938/ 4302 |
| Alteromonas macleodii Black Sea 11 uid176365 | 2290017 | 2302123 | 407700182/ 4956 | 407700181/ 5573 | 407700180/ 620 | 407700179/ 2771 | 407700176/ 1719 | missing |
| Anaeromyxobacter dehalogenans 2CP C uid58135 | 3688393 | 3701032 | 86159656/ 4957 | 86159655/ 5574 | 86159654/ 621 | 86159653/ 2772 | 86159652/ 1720 | 86159651/ 4303 |
| Aromatoleum aromaticum EbN1 uid58231 | 3091305 | 3115719 | 56478397/ 4958 | 56478398/ 5575 | 56478399/ 622 | 56478402/ 2773 | 56478415/ 1721 | 56478416/ 4304 |
| Arthrobacter nitroguajacolicus Rue61a uid174511 | 73164 | 86048 | 403571626/ 4959 | 403571625/ 5576 | 403571624/ 623 | 403571623/ 2774 | 403571622/ 1722 | 403571621/ 4305 |
| Azospirillum lipoferum 4B uid82343 | 149169 | 163502 | 374998149/ 4960 | 374998148/ 5577 | 374998147/ 624 | 374998346/ 2775 | 374998144/ 1723 | 374998143/ 4306 |
| Bifidobacterium animalis ATCC 25527 uid162513 | 1014525 | 1027987 | 386867047/ 4961 | 386867048/ 5578 | 386867049/ 625 | 386867050/ 2776 | 386867051/ 1724 | 386867052/ 4307 |
| Bordetella parapertussis Bpp5 uid177516 | 553819 | 571957 | 410471294/ 4962 | 410471295/ 5579 | 410471296/ 626 | missing | 410471301/ 1725 | 410471302/ 4308 |
| Burkholderia CCGE1001 uid42975 | 3119203 | 3136704 | 323527071/ 4963 | 323527070/ 5580 | 323527069/ 627 | 323527068/ 2777 | 323527064/ 1726 | 323527063/ 4309 |
| Burkholderia gladioli BSR3 uid66301 | 1574842 | 1588059 | 330816346/ 4964 | 330816347/ 5581 | 330816348/ 628 | 330816349/ 2778 | 330816350/ 1727 | 330816351/ 4310 |
| Burkholderia vietnamiensis G4 uid58075 | 2201159 | 2216554 | 134296121/ 4965 | 134296120/ 5582 | 134296119/ 629 | missing | 134296116/ 1728 | 134296115/ 4311 |
| Calditerrivibrio nitroreducens DSM 19672 uid60821 | 2095967 | 2108863 | 313673975/ 4966 | 313673974/ 5583 | 313673973/ 630 | 313673970/ 2779 313673972/ 2780 | 313673969/ 1729 | 313673968/ 4312 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Carboxydothermus hydrogenoformans Z 2901 uid57821 | 2348822 | 2361903 | 78044585/ 4967 | 78043641/ 5584 | 78043274/ 631 | 78045163/ 2781 | 78043267/ 1730 | 78044476/ 4313 |
| Chlorobium phaeobacteroides BS1 uid58131 | 1811539 | 1826075 | 189500612/ 4968 | 189500611/ 5585 | 189500610/ 632 | 189500607/ 2782 | 189500606/ 1731 | 189500605/ 4314 |
| Clostridium clariflavum DSM 19732 uid82345 | 253005 | 267426 | 374294724/ 4969 | 374294725/ 5586 | 374294726/ 633 | 374294727/ 2783 | 374294728/ 1732 | 374294730/ 4315 |
| Clostridium clariflavum DSM 19732 uid82345 | 3398998 | 3420023 | 374297215/ 4970 | 374297214/ 5587 | 374297213/ 634 | 374297205/ 2784 374297212/ 2785 | 374297210/ 1733 | 374297209/ 4316 |
| Clostridium ljungdahlii DSM 13528 uid50583 | 3566678 | 3580351 | 300856437/ 4971 | 300856436/ 5588 | 300856435/ 635 | 300856434/ 2786 | 300856433/ 1734 | 300856431/ 4317 |
| Clostridium saccharolyticum WM1 uid51419 | 3014507 | 3029581 | 302387139/ 4972 | 302387138/ 5589 | 302387137/ 636 | 302387135/ 2787 | 302387132/ 1735 | 302387131/ 4318 |
| Clostridium saccharolyticum WM1 uid51419 | 3993471 | 4020337 | 302388017/ 4973 | 302388016/ 5590 | 302388015/ 637 | 302388014/ 2788 302388025/ 2789 | 302388010/ 1736 | 302388009/ 4319 |
| Clostridium sticklandii DSM 519 uid59585 | 1172754 | 1188589 | 310658338/ 4974 | 310658339/ 5591 | 310658340/ 638 | 310658341/ 2790 | 310658344/ 1737 | 310658345/ 4320 |
| Clostridium SY8519 uid68705 | 1975332 | 1994115 | 339442901/ 4975 | 339442902/ 5592 | 339442903/ 639 | 339442905/ 2791 | 339442908/ 1738 | 339442909/ 4321 |
| Cupriavidus necator N 1 uid68689 | 3467556 | 3485436 | 339327422/ 4976 | 339327421/ 5593 | 339327420/ 640 | 339327417/ 2792 | 339327415/ 1739 | 339327414/ 4322 |
| Cyanothece PCC 8802 uid59143 | 2210337 | 2225482 | missing | 257060039/ 5594 | 257060038/ 641 | 257060035/ 2793 257060036/ 2794 | 257060032/ 1740 | 257060031/ 4323 |
| Dehalococcoides VS uid42393 | 231698 | 257903 | 270307694/ 4977 | missing | 270307693/ 642 | 270307692/ 2795 | 270307691/ 1741 | 270307690/ 4324 |
| Dehalogenimonas lykanthroporepellens BL DC 9 uid48131 | 1578285 | 1603624 | 300088705/ 4978 | 300088704/ 5595 | 300088703/ 643 | 300088702/ 2796 | 300088701/ 1742 | 300088700/ 4325 |
| Desulfitobacterium hafniense Y51 uid58605 | 783463 | 806836 | 89893421/ 4979 | missing | 89893422/ 644 | 89893423/ 2797 | 89893425/ 1743 | 89893426/ 4326 |
| Desulfobacula toluolica Tol2 uid175777 | 3358272 | 3374466 | 408420315/ 4980 | 408420314/ 5596 | 408420313/ 645 | 408420312/ 2798 | 408420308/ 1744 | 408420307/ 4327 |
| Desulfomicrobium baculatum DSM 4028 uid59217 | 1457030 | 1471353 | 256829115/ 4981 | 256829114/ 5597 | 256829113/ 646 | 256829112/ 2799 | 256829110/ 1745 | 256829109/ 4328 |
| Desulfosporosinus meridiei DSM 13257 uid75097 | 360901 | 375372 | 402570959/ 4982 | 402570960/ 5598 | 402570961/ 647 | 402570962/ 2800 | 402570964/ 1746 | 402570965/ 4329 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Desulfovibrio magneticus RS 1 uid59309 | 4071986 | 4104148 | 239908253/ 4983 | 239908252/ 5599 | 239908251/ 648 | 239908250/ 2801 | 239908248/ 1747 | 239908247/ 4330 |
| Desulfovibrio vulgaris Hildenborough uid57645 | 2096176 | 2110453 | missing | 46580433/ 5600 | 46580432/ 649 | 46580429/ 2802 | 46580427/ 1748 | 46580426/ 4331 |
| Desulfovibrio vulgaris RCH1 uid161961 | 1472132 | 1487041 | 387153153/ 4984 | 387153154/ 5601 | 387153155/ 650 | 387153158/ 2803 | 387153160/ 1749 | 387153161/ 4332 |
| Desulfurvibrio alkaliphilus AHT2 uid49487 | 2512933 | 2529324 | 297570111/ 4985 | 297570110/ 5602 | 297570109/ 651 | 297570107/ 2804 | 297570104/ 1750 | 297570103/ 4333 |
| Enterobacter cloacae ENHKU01 uid172463 | 567010 | 586287 | 401762044/ 4986 | 401762043/ 5603 | 401762042/ 652 | 401762037/ 2805 401762040/ 2806 | 401762036/ 1751 | 401762035/ 4334 |
| Erwinia Ejp617 uid159955 | 2111476 | 2142932 | 385787391/ 4987 | 385787390/ 5604 | 385787389/ 653 | 385787388/ 2807 | 385787387/ 1752 | 385787386/ 4335 |
| Erwinia pyrifoliae DSM 12163 uid159693 | 3075305 | 3107294 | 387872410/ 4988 | 387872411/ 5605 | 387872412/ 654 | 387872413/ 2808 | 387872414/ 1753 | 387872415/ 4336 |
| Erwinia pyrifoliae Ep1 96 uid40659 | 3075240 | 3107369 | 259909430/ 4989 | 259909431/ 5606 | 259909432/ 655 | 259909433/ 2809 | 259909434/ 1754 | 259909435/ 4337 |
| Erythrobacter litoralis HTCC2594 uid58299 | 2963192 | 2977697 | 85375770/ 4990 | 85375772/ 5607 | 85375773/ 656 | 85375776/ 2810 | 85375777/ 1755 | 85375778/ 4338 |
| Escherichia coli clone D i14 uid162049 | 4888341 | 4901877 | 386637210/ 4991 | 386637211/ 5608 | 386637212/ 657 | 386637213/ 2811 | 386637214/ 1756 | 386637215/ 4339 |
| Escherichia coli clone D i2 uid162047 | 4888341 | 4901877 | 386632290/ 4992 | 386632291/ 5609 | 386632292/ 658 | 386632293/ 2812 | 386632294/ 1757 | 386632295/ 4340 |
| Escherichia coli HS uid58393 | 335287 | 354284 | 157159789/ 4993 | 157159790/ 5610 | 157159791/ 659 | 157159784/ 2813 157159792/ 2814 | 157159793/ 1758 | 157159794/ 4341 |
| Escherichia coli O111 H 11128 uid41023 | 5250831 | 5264277 | 260871026/ 4994 | 260871025/ 5611 | 260871024/ 660 | 260871023/ 2815 | 260871022/ 1759 | 260871021/ 4342 |
| Escherichia fergusonii ATCC 35469 uid59375 | 13818 | 28892 | 218561657/ 4995 | 218561658/ 5612 | 218561659/ 661 | 218561661/ 2816 | 218561662/ 1760 | 218561663/ 4343 |
| Exiguobacterium sibiricum 255 15 uid58053 | 325862 | 338929 | 172056355/ 4996 | 172056356/ 5613 | 172056357/ 662 | 172056358/ 2817 | 172056359/ 1761 | 172056360/ 4344 |
| Flavobacterium branchiophilum FL 15 uid73421 | 1185032 | 1201974 | 347535923/ 4997 | 347535922/ 5614 | 347535921/ 663 | 347535920/ 2818 | 347535914/ 1762 | 347535913/ 4345 |
| Gallionella capsiferriformans ES 2 uid51505 | 927586 | 949290 | 302878114/ 4998 | 302878115/ 5615 | 302878116/ 664 | 302878119/ 2819 | 302878127/ 1763 | 302878128/ 4346 |
| Gallionella capsiferriformans ES 2 uid51505 | 1651741 | 1666045 | 302878739/ 4999 | 302878740/ 5616 | 302878741/ 665 | 302878744/ 2820 | 302878745/ 1764 | 302878746/ 4347 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Geobacillus WCH70 uid59045 | 1353239 | 1367357 | 239826787/ 5000 | 239826788/ 5617 | 239826789/ 666 | 239826790/ 2821 | 239826791/ 1765 | 239826791/ missing |
| Geobacter sulfurreducens PCA uid57743 | 2316569 | 2330889 | 400756604/ 5001 | 39997207/ 5618 | 39997206/ 667 | 39997205/ 2822 | 39997204/ 1766 | 39997203/ 4348 |
| Haliscomenobacter hydrossis DSM 1100 uid66777 | 16078 | 32343 | 332661910/ 5002 | 332661909/ 5619 | 332661908/ 668 | 332661907/ 2823 | 332661904/ 1767 | 332661903/ 4349 |
| Halobacillus halophilus DSM 2266 uid162033 | 4050129 | 4064174 | 386716369/ 5003 | 386716368/ 5620 | 386716367/ 669 | 386716366/ 2824 | 386716365/ 1768 | 386716365/ missing |
| Halobacteroides halobius DSM 5150 uid184862 | 1069387 | 1096994 | 435853824/ 5004 | 435853825/ 5621 | 435853826/ 670 | 435853813/ 2825 435853827/ 2826 | 435853828/ 1769 | 435853828/ missing |
| Klebsiella oxytoca E718 uid170256 | 604335 | 617733 | 397655648/ 5005 | 397655647/ 5622 | 397655646/ 671 | missing | 397655645/ 1770 | 397655644/ 4350 |
| Lactobacillus amylovorus GRL1118 uid160233 | 1026146 | 1040270 | 385817604/ 5006 | 385817605/ 5623 | 385817606/ 672 | 385817607/ 2827 | 385817611/ 1771 | 385817611/ missing |
| Lactobacillus casei Zhang uid50673 | 2008783 | 2025228 | 301067096/ 5007 | 301067095/ 5624 | 301067094/ 673 | 301067091/ 2828 301067093/ 2829 | 301067090/ 1772 | 301067089/ 4351 |
| Lactobacillus helveticus H10 uid162017 | 1063828 | 1077153 | 385813809/ 5008 | 385813808/ 5625 | 385813807/ 674 | 385813806/ 2830 | 385833804/ 1773 | 385833804/ missing |
| Lactobacillus helveticus R0052 uid174439 | 1053700 | 1068738 | 403515037/ 5009 | 403515036/ 5626 | 403515035/ 675 | 403515034/ 2831 | 403515031/ 1774 | 403515031/ missing |
| Lactobacillus johnsonii F19785 uid41735 | 939269 | 953168 | 268319510/ 5010 | 268319509/ 5627 | 268319508/ 676 | 268319507/ 2832 | 268319503/ 1775 | 268319503/ missing |
| Lactobacillus reuteri SD2112 uid55357 | 1310070 | 1322351 | 338203658/ 5011 | 338203659/ 5628 | 338203660/ 677 | 338203661/ 2833 | 338203664/ 1776 | 338203664/ missing |
| Lactobacillus rhamnosus GG uid161983 | 2148408 | 2164793 | 385828739/ 5012 | 385828738/ 5629 | 385828737/ 678 | 385828734/ 2834 385828736/ 2835 | 385828733/ 1777 | 385828732/ 4352 |
| Lactobacillus rhamnosus GG uid59313 | 2154002 | 2170387 | 258509095/ 5013 | 258509094/ 5630 | 258509093/ 679 | 258509090/ 2836 258509092/ 2837 | 258509089/ 1778 | 258509088/ 4353 |
| Leuconostoc kimchii IMSNU 11154 uid48589 | 34359 | 50836 | 296110181/ 5014 | 296110180/ 5631 | 296110179/ 680 | 296110176/ 2838 296110178/ 2839 | 296110175/ 1779 | 296110174/ 4354 |
| Methanobrevibacter smithii ATCC 35061 uid58827 | 1795593 | 1818647 | 148643809/ 5015 | 148643810/ 5632 | 148643811/ 681 | 148643803/ 2840 148643804/ | 148643813/ 1780 | 148643814/ 6165 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Methanoculleus bourgensis MS2 uid171377 | 985372 | 997463 | 397780113/ 5016 | 397780112/ 5633 | 397780111/ 682 | 397780110/ 2846 | 397780109/ 1781 | 397780108/ 4355 |
| Methanolobus psychrophilus R15 uid177925 | 146902 | 163611 | missing | 410669356/ 5634 | 410669357/ 683 | 410669358/ 2847 410669360/ 2848 | 410669363/ 1782 | 410669364/ 4356 |
| Methanomethylovorans hollandica DSM 15978 uid184864 | 1359134 | 1396372 | missing | 435851551/ 5635 | 435851550/ 684 | 435851525/ 2849 435851546/ 2850 435851549/ 2851 | 435851539/ 1783 | 435851538/ 4357 |
| Methanosarcina acetivorans C2A uid57879 | 2919153 | 2939722 | missing | 20091206/ 5636 | 20091205/ 685 | 20091204/ 2852 | 20091198/ 1784 | 20091197/ 4358 |
| Methanosarcina mazei Go1 uid57893 | 193892 | 214864 | missing | 21226255/ 5637 | 21226256/ 686 | 21226258/ 2853 | 21226265/ 1785 | 21226266/ 4359 |
| Methanospirillum hungatei JF 1 uid58181 | 1213815 | 1228530 | 88602375/ 5017 | 88602374/ 5638 | 88602373/ 687 | 88602371/ 2854 | 88602368/ 1786 | 88602367/ 4360 |
| Methanospirillum hungatei JF 1 uid58181 | 2137148 | 2153998 | missing | 88603149/ 5639 | 88603150/ 688 | 88603151/ 2855 | 88603159/ 1787 | 88603160/ 4361 |
| Microlunatus phosphovorus NM 1 uid68055 | 4106044 | 4121700 | 336119446/ 5018 | 336119447/ 5640 | 336119448/ 689 | 336119449/ 2856 336119450/ 2857 336119452/ 2858 | 336139454/ 1788 | 336119455/ 4362 |
| Moorella thermoacetica ATCC 39073 uid58051 | 2331989 | 2347051 | 83591065/ 5019 | 83591064/ 5641 | 83591063/ 690 | 83591059/ 2859 83591062/ 2860 | 83591058/ 1789 | 83591057/ 4363 |
| Parvularcula bermudensis HTCC2503 uid51641 | 1068558 | 1081391 | 304320704/ 5020 | 304320703/ 5642 | 304320702/ 691 | 304320701/ 2861 | 304320700/ 1790 | 304320699/ 4364 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| *Pectobacterium carotovorum* PCC21 uid174335 | 3681934 | 3716221 | 403059706/ 5021 | 403059707/ 5643 | 403059708/ 692 | 403059688/ 2862 403059709/ 2863 | 403059710/ 1791 | 403059711/ 4365 |
| *Pelobacter propionicus* DSM 2379 uid58255 | 2459983 | 2475529 | 118580706/ 5022 | 118580705/ 5644 | 118580704/ 693 | 118580703/ 2864 | 118580699/ 1792 | 118580698/ 4366 |
| *Pelodictyon phaeoclathratiforme* BU 1 uid58173 | 2122302 | 2136560 | 194337066/ 5023 | 194337067/ 5645 | 194337068/ 694 | 194337069/ 2865 | 194337071/ 1793 | 194337072/ 4367 |
| *Photorhabdus asymbiotica* uid59243 | 470261 | 481491 | 253987910/ 5024 | 253987911/ 5646 | 253987912/ 695 | 253987913/ 2866 | 253987914/ 1794 | Missing |
| *Polaromonas* JS666 uid58207 | 120587 | 142418 | 91790841/ 5025 | 91790842/ 5647 | 91790843/ 696 | 91790846/ 2867 | 91790850/ 1795 | 91790851/ 4368 |
| *Pseudomonas brassicacearum* NFM421 uid66303 | 940354 | 955546 | 330807432/ 5026 | 330807433/ 5648 | 330807434/ 697 | 330807435/ 2868 | 330807437/ 1796 | 330807438/ 4369 |
| *Pseudomonas stutzeri* CCUG 29243 uid168379 | 1382383 | 1400530 | 392420331/ 5027 | 392420330/ 5649 | 392420329/ 698 | 392420323/ 2869 392420328/ 2870 | 392420322/ 1797 | 392420321/ 4370 |
| *Psychrobacter cryohalolentis* K5 uid58373 | 1973411 | 1984296 | 93006435/ 5028 | 93006434/ 5650 | 93006433/ 699 | 93006432/ 2871 | 93006431/ 1798 | Missing |
| *Rhodococcus erythropolis* PR4 uid59019 | 3099107 | 3111990 | 226306385/ 5029 | 226306384/ 5651 | 226306383/ 700 | 226306382/ 2872 | 226306381/ 1799 | 226306380/ 4371 |
| *Rhodopseudomonas palustris* TIE 1 uid58995 | 1186657 | 1200150 | 192289534/ 5030 | 192289535/ 5652 | 192289536/ 701 | 192289537/ 2873 | 192289538/ 1800 | 192289539/ 4372 |
| *Saccharophagus degradans* 2 40 uid57921 | 3482579 | 3496946 | 90022404/ 5031 | 90022403/ 5653 | 90022402/ 702 | 90022401/ 2874 | 90022398/ 1801 | 90022397/ 4373 |
| *Salmonella enterica* serovar *Typhimurium* 14028S uid86059 | 4749510 | 4764672 | 378453463/ 5032 | 378453462/ 5654 | 378453461/ 703 | 378453460/ 2875 | 378453457/ 1802 | 378453456/ 4374 |
| *Salmonella enterica* serovar *Typhimurium* 798 uid158047 | 4755689 | 4770857 | 383499057/ 5033 | 383499056/ 5655 | 383499055/ 704 | 383499054/ 2876 | 383499051/ 1803 | 383499050/ 4375 |
| *Salmonella enterica* serovar *Typhimurium* LT2 uid57799 | 4736677 | 4751839 | 16767742/ 5034 | 16767741/ 5656 | 16767740/ 705 | 16767739/ 2877 | 16767736/ 1804 | 16767735/ 4376 |
| *Salmonella enterica* serovar *Typhimurium* SL1344 uid86645 | 4757260 | 4772422 | 378702331/ 5035 | 378702330/ 5657 | 378702329/ 706 | 378702328/ 2878 | 378702325/ 1805 | 378702324/ 4377 |
| *Salmonella enterica* serovar *Typhimurium* ST4 74 uid84393 | 4757261 | 4772429 | 379703735/ 5036 | 379703734/ 5658 | 379703733/ 707 | 379703732/ 2879 | 379703729/ 1806 | 379703728/ 4378 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| *Salmonella enterica* serovar *Typhimurium* T000240 uid84397 | 4834059 | 4849227 | 378987165/ 5037 | 378987364/ 5659 | 378987163/ 708 | 378987162/ 2880 | 378987159/ 1807 | 378987158/ 4379 |
| *Salmonella enterica* serovar *Typhimurium* uid86061 | 4758667 | 4773829 | 378447805/ 5038 | 378447804/ 5660 | 378447803/ 709 | 378447802/ 2881 | 378447799/ 1808 | 378447798/ 4380 |
| *Salmonella enterica* serovar *Typhimurium* UK 1 uid87049 | 4697115 | 4712277 | 378991759/ 5039 | 378991758/ 5661 | 378991757/ 710 | 378991756/ 2882 | 378991753/ 1809 | 378991752/ 4381 |
| *Selenomonas sputigena* ATCC 35185 uid55329 | 820667 | 833330 | 330838573/ 5040 | 330838574/ 5662 | 330838575/ 711 | 330838576/ 2883 | 330838578/ 1810 | Missing |
| *Shewanella* ANA 3 uid58347 | 2142947 | 2155062 | 117920263/ 5041 | 117920264/ 5663 | 117920265/ 712 | 117920266/ 2884 | 117920268/ 1811 | Missing |
| *Shewanella* MR 4 uid58345 | 2018034 | 2030135 | 113970045/ 5042 | 113970046/ 5664 | 113970047/ 713 | 113970048/ 2885 | 113970050/ 1812 | Missing |
| *Slackia heliotrinireducens* DSM 20476 uid59051 | 349608 | 366195 | 257063043/ 5043 | 257063042/ 5665 | 257063041/ 714 | 257063038/ 2886 257063039/ 2887 | 257063040/ 1813 | 257063036/ 4382 |
| *Spirosoma linguale* DSM 74 uid43413 | 5893753 | 5908214 | 284039689/ 5044 | 284039690/ 5666 | 284039691/ 715 | 284039694/ 2888 | 284039695/ 1814 | 284039696/ 4383 |
| *Sulfuricurvum kujiense* DSM 16994 uid60789 | 1691724 | 1708885 | 313682809/ 5045 | 313682810/ 5667 | 313682811/ 716 | 313682812/ 2889 313682817/ 2890 | 313682819/ 1815 | 313682820/ 4384 |
| *Synechococcus* PCC 6312 uid182934 | 875746 | 901348 | 427712028/ 5046 | 427712029/ 5668 | 427712030/ 717 | 427712018/ 2891 427712032/ 2892 | 427712035/ 1816 | 427712036/ 4385 |
| *Syntrophomonas wolfei* Goettingen uid58179 | 1119627 | 1137082 | 114566519/ 5047 | 114566520/ 5669 | 114566521/ 718 | 114566522/ 2893 114566525/ 2894 114566528/ 2895 | 114566529/ 1817 | 114566530/ 4386 |
| *Syntrophomonas wolfei* Goettingen uid58179 | 2823944 | 2853705 | 114568002/ 5048 | 114568001/ 5670 | 114568000/ 719 | 114567997/ 2896 114567999/ 2897 114568012/ 2898 | 114567995/ 1818 #N/A #N/A | 114567994/ 4387 |
| *Syntrophus aciditrophicus* SB uid58539 | 932420 | 951906 | 85858754/ 5049 | 85858752/ 5671 | 85858751/ 720 | 85858747/ 2899 | 85858744/ 1819 | 85858743/ 4388 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| *Tepidanaerobacter acetatoxydans* Re1 uid184827 | 565314 | 579879 | 438001500/ 5050 | 438001501/ 5672 | 438001502/ 721 | 438001506/ 438001507/ 2900 438001507/ 2901 | 438001508/ 1820 | 438001509/ 4389 |
| *Tepidanaerobacter* Re1 uid66873 | 564518 | 579375 | 332798527/ 5051 | 332798528/ 5673 | 332798529/ 722 | 332798531/ 2902 | 332798532/ 1821 | 332798533/ 4390 |
| *Thauera* MZ1T uid58987 | 325210 | 347552 | 217968744/ 5052 | 217968745/ 5674 | 217968746/ 723 | 217968749/ 2903 | 217968754/ 1822 | 217968755/ 4391 |
| *Thermacetogenium phaeum* DSM 12270 uid177811 | 2228448 | 2241200 | 410668523/ 5053 | 410668522/ 5675 | 410668521/ 724 | 410668520/ 2904 | 410668519/ 1823 | 410668518/ 4392 |
| *Thermoanaerobacterium thermosaccharolyticum* DSM 571 uid51639 | 483298 | 496321 | 304316004/ 5054 | 304316005/ 5676 | 304316006/ /725 | 304316007/ 2905 | 304316008/ 1824 | 304316009/ 4393 |
| *Thiocystis violascens* DSM 198 uid74025 | 1605822 | 1624356 | 390949850/ 5055 | 390949849/ 5677 | 390949848/ 726 | 390949845/ 2906 | 390949842/ 1825 | Missing |
| *Thioflavicoccus mobilis* 8321 uid184343 | 70557 | 88066 | 431933024/ 5056 | 431933023/ 5678 | 431933022/ 727 | 431933018/ 431933021/ 2907 431933021/ 2908 | 431933015/ 1826 | 431933014/ 4394 |
| *Vibrio cholerae* MJ 1236 uid59387 | 3021293 | 3036340 | 229608800/ 5057 | 229608799/ 5679 | 229608798/ 728 | 229608796/ 2909 | 229608795/ 1827 | 229608794/ 4395 |
| *Vibrio cholerae* O1 2010EL 1786 uid78933 | 110486 | 123671 | 360034501/ 5058 | 360034502/ 5680 | 360034503/ 729 | 360034504/ 2910 | 360034505/ 1828 | 360034506/ 4396 |
| *Zymomonas mobilis* NCIMB 11163 uid41019 | 1590155 | 1602973 | 260753603/ 5059 | 260753604/ 5681 | 260753605/ 730 | 260753606/ 2911 | 260753607/ 1829 | 260753608/ 4397 |
| *Magnetospirillum magneticum* AMB 1 uid58527 | 2215526 | 2231935 | 83311137/ 5060 | 83311138/ 5682 | 83311139/ 731 83311142/ 732 | 83311143/ 2912 | 83311145/ 1830 | 83311146/ 4398 |
| *Marinobacter aquaeolei* VT8 uid59419 | 627682 | 647744 | 120553492/ 5061 | 120553493/ 5683 | 120553494/ 733 | 120553498/ 2913 | 120553501/ 1831 | 120553502/ 4399 |
| *Nostoc punctiforme* PCC 73102 uid57767 | 6986741 | 7000722 | 186685714/ 5062 | 186685707/ 5684 | 186685708/ 734 | 186685709/ 2914 | 186685712/ 1832 | 186685713/ 4400 |
| *Rhodobacter sphaeroides* AITCC 17025 uid58451 | 628475 | 643049 | 146279749/ 5063 | 146279748/ 5685 | Rsph17025_3734/ 615 | 146279745/ 2915 | 146279744/ 1833 | 146279743/ 4401 |
| *Runella slithyformis* DSM 19594 uid68317 | 4922398 | 4938169 | 338213691/ 5064 | 338213690/ 5686 | 338213689/ 735 | 338213688/ 2916 | 338213683/ 1834 | 338213682/ 4402 |
| *Acidovorax* sp. NO-1 | 4749 | 20769 | 365096841/ 5336 | 365096842/ 5905 | 365096843/ 1072 | 365096846/ 3214 | 365096849/ 2158 | 365096850/ 4265 |
| *Acinetobacter baumannii* OIFC098 | 33402 | 52203 | 421624927/ 5341 | 421624915/ 5911 | 421624913/ 1078 | 421624892/ 3219 | 421624935/ 2164 | 421624974/ 4271 |
| *Acinetobacter baumannii* WC-136 | 57480 | 72041 | 427425605/ 5342 | 427425618/ 5912 | 427425586/ 1079 | 427425611/ 3220 | 427425576/ 2165 | 427425548/ 4272 |

TABLE 10-continued

| Organism | Genomic Start Point | Genomic End Point | BREX type 1 systems | | | | | |
|---|---|---|---|---|---|---|---|---|
| | | | brxA* | brxB* | brxC* | pglX* | pglZ* | brxL* |
| *Acinetobacter* sp. P8-3-8 | 1850 | 16994 | 358012810/ 5326 | 358012809/ 5895 | 358012808/ 1062 | 358012807/ 3204 | 358012805/ 2147 | 358012804/ 4256 |
| *Actinomyces neuii* BVS029A5 | 83071 | 96264 | 405982588/ 5356 | 405982587/ 5927 | 405982586/ 1094 | 405982584/ 3235 405982585/ 3236 | 405982583/ 2180 | 405982582/ 4287 |
| *Aurantimonas manganoxydans* SI85-9A1 | 1067851 | 1080860 | 90418999/ 5319 | 90418998/ 5888 | 90418997/ 1055 | 90418996/ 3197 | 90418995/ 2140 | 90418994/ 4250 |
| *Bacillus cereus* H3081.97 | 89926 | 103011 | 206975566/ 5306 | 206975742/ 5875 | 206975617/ 1041 | 206975739/ 3181 | 206975748/ 2126 | 206975706/ 4236 |
| *Bacteroides ovatus* SD CC 2a | 22479 | 38083 | 294645431/ 5364 | 294645432/ 5936 | 294645433/ 1103 294645434/ 1104 | 294645435/ 3246 | 294645438/ 2189 | 294645439/ 4295 |
| *Bacteroides* sp. 2_1_7 | 444155 | 466254 | 255014563/ 5312 | 255014564/ 5881 | 255014565/ 1048 | 255014566/ 3190 | 255014573/ 2133 | 255014574/ 4243 |
| *Bacteroides* sp. 3_1_33FAA | 15816 | 30563 | 265757021/ 5329 | 265757020/ 5898 | 265757019/ 1065 | 265757018/ 3207 | 265757016/ 2150 | 265757015/ 4259 |
| *Bacteroides* sp. D2 | 958538 | 975774 | 383114785/ 5327 | 383114786/ 5896 | 383114787/ 1063 | 383114788/ 3205 | 383114792/ 2148 | 383114793/ 4257 |
| *Bacteroides* sp. 2_1_22 | 149553 | 165156 | 262405135/ 5346 | 262405136/ 5916 | 262405137/ 1083 | 262405138/ 3224 | 262405141/ 2169 | 262405142/ 4276 |
| *Clostridium perfringens* C str. JGS1495 | 27368 | 50007 | 169343970/ 5355 | 169343964/ 5926 | 169343946/ 1093 | 169343972/ 3234 | 169343967/ 2179 | 169343977/ 4286 |
| *Collinsella aerofaciens* ATCC 25986 | 42484 | 56961 | 139439063/ 5309 | 139439064/ 5878 | 139439065/ 1045 | 139439066/ 3186 139439068/ 3187 | 139439069/ 2130 | 139439070/ 4240 |
| *Coprobacillus* sp. 3_3_56FAA | 950856 | 973460 | 365831804/ 5367 | 365831805/ 5939 | 365831806/ 1109 365831811/ 1110 | 365831813/ 3251 | 365831816/ 2192 | 365831817/ 4298 |
| *Desulfonatronospira thiodismutans* ASO3-1 | 1059989 | 1073987 | missing | 298528557/ 5906 | 298528556/ 1073 | 298528555/ 3215 | 298528552/ 2159 | 298528551/ 4266 |
| *Enterobacter hormaechei* ATCC 49162 | 1757377 | 1772326 | 334125669/ 5289 | 334125670/ 5859 | 334125671/ 1023 | 334125672/ 3159 | 334125675/ 2108 | 334125676/ 4218 |
| *Enterococcus faecium* 511 | 192 | 13547 | 425040991/ 5316 | 425040992/ 5885 | 425040993/ 1052 | 425040994/ 3194 | 425040995/ 2137 | 425040996/ 4247 |
| *Enterococcus faecium* E1731 | 141305 | 154660 | 431534711/ 5294 | 431534712/ 5864 | 431534713/ 1028 | 431534714/ 3164 | 431534715/ 2113 | 431534716/ 4223 |
| *Enterococcus faecium* E2883 | 294802 | 308157 | 431753899/ 5357 | 431753900/ 5928 | 431753901/ 1095 | 431753902/ 3237 | 431753903/ 2181 | 431753904/ 4288 |
| *Enterococcus faecium* TX0133C | 192 | 13547 | 314941479/ 5310 | 314941480/ 5879 | 314941481/ 1046 | 314941482/ 3188 | 314941483/ 2131 | 314941484/ 4241 |

TABLE 10-continued

| Organism | Genomic Start Point | Genomic End Point | brxA* | brxB* | brxC* | pglX* | pglZ* | brxL* |
|---|---|---|---|---|---|---|---|---|
| Escherichia coli 4.0522 | 178149 | 191595 | 417191592/ 5344 | 417191528/ 5914 | 417191550/ 1081 | 417191518/ 3222 | 417191624/ 2167 | 417191569/ 4274 |
| Escherichia coli B41 | 177464 | 190841 | 417293178/ 5358 | 417293264/ 5929 | 417292957/ 1096 | 417293087/ 3238 | 417293167/ 2182 | 417293248/ 4289 |
| Escherichia coli B799 | 163075 | 176512 | 423709631/ 5291 | 423709630/ 5861 | 423709629/ 1025 | 423709628/ 3161 | 423709627/ 2110 | 423709626/ 4220 |
| Escherichia coli DEC13A | 68462 | 81854 | 419343549/ 5366 | 419343548/ 5938 | 419343546/ 1107 419343547/ 1108 | 419343544/ 3249 419343545/ 3250 | 419343543/ 2191 | 419343542/ 4297 |
| Escherichia coli DEC13E | 154888 | 168171 | 419368024/ 5365 | 419368147/ 5937 | 419368080/ 1105 419368151/ 1106 | 419368110/ 3247 419368121/ 3248 | 419368013/ 2190 | 419368125/ 4296 |
| Escherichia coli DEC14C | 502 | 13913 | 419383946/ 5299 | 419383945/ 5869 | 419383944/ 1033 | 419383942/ 3171 419383943/ 3172 | 419383941/ 2118 | 419383940/ 4228 |
| Escherichia coli DEC9A | 165882 | 179328 | 419230123/ 5347 | 419230122/ 5918 | 419230121/ 1085 | 419230120/ 3226 | 419230119/ 2171 | 419230118/ 4278 |
| Escherichia coli DEC9C | 126845 | 140290 | 419240873/ 5298 | 419240872/ 5868 | 419240871/ 1032 | 419240869/ 3169 419240870/ 3170 | 419240868/ 2117 | 419240867/ 4227 |
| Escherichia coli DEC9D | 302405 | 315851 | 419246584/ 5339 | 419246583/ 5909 | 419246582/ 1076 | 419246581/ 3217 | 419246580/ 2162 | 419246579/ 4269 |
| Escherichia coli O111:H8 str. CVM9574 | 50533 | 63979 | 419894759/ 5350 | 419894758/ 5921 | 419894757/ 1088 | 419894756/ 3229 | 419894755/ 2174 | 419894754/ 4281 |
| Escherichia coli O111:H8 str. CVM9602 | 70169 | 83615 | 420088377/ 5303 | 420088376/ 5873 | 420088375/ 1038 | 420088374/ 3178 | 420088373/ 2123 | 420088372/ 4233 |
| Faecalibacterium prausnitzii M21/2 | 28608 | 45887 | 160944222/ 5325 | 160944223/ 5894 | 160944224/ 1061 | 160944228/ 3203 | 160944230/ 2146 | 160944231/ 4255 |
| Fusobacterium necrophorum subsp necrophorum sp. 2_1_31 | 64292 | 79742 | 419841769/ 5361 | 419841708/ 5932 | 419843735/ 1099 | 419841801/ 3241 | 419841754/ 2185 | Missing |
| Fusobacterium sp. 2_1_31 | 435830 | 468937 | 340752713/ 5317 | 340752714/ 5886 | 340752704/ 1053 | 340752707/ 3195 | 340752711/ 2138 | 340752712/ 4248 |
| Fusobacterium sp. 7_1 | 589947 | 618478 | 237744585/ 5354 | 237744584/ 5925 | 237744599/ 1092 | 237744596/ 3233 | 237744587/ 2178 | 237744586/ 4285 |
| Glaciecola lipolytica E3 | 6001 | 19207 | 410637162/ 5295 | 410637163/ 5865 | 410637164/ 1029 | 410637165/ 3165 | 410637166/ 2114 | 410637167/ 4224 |
| Lachnospiraceae bacterium oral taxon 082 str | 81164 | 93860 | 373469122/ 5332 | 373469123/ 5901 | 373469124/ 1068 | 373469126/ 3210 373469127/ 2153 373469128/ 2154 | | Missing |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Lactobacillus casei UW4 | 4097 | 20782 | 418008633/ 5293 | 418008632/ 5863 | 418008631/ 1027 | 418008628/ 3162 418008630/ 3163 | 418008627/ 2112 | 418008626/ 4222 |
| Lactobacillus helveticus DSM 20075 | 82009 | 98806 | 260101570/ 5323 | 260101569/ 5892 | 260101568/ 1059 | 260101567/ 3201 | 260101564/ 2144 | Missing |
| Lactobacillus zeae KCTC 3804 | 53700 | 70162 | 366087504/ 5363 | 366087503/ 5935 | 366087502/ 1102 | 366087499/ 3244 366087501/ 3245 | 366087498/ 2188 | 366087497/ 4294 |
| Magnetospirillum sp. SO-1 | 2351 | 15314 | 458920178/ 5338 | 458920177/ 5908 | 458920176/ 1075 | missing | 458920175/ 2161 | 458920174/ 4268 |
| Magnetospirillum sp. SO-1 | 12059 | 25247 | 458913831/ 5343 | 458913830/ 5913 | 458913829/ 1080 | 458913827/ 3221 | 458913826/ 2166 | 458913825/ 4273 |
| Marinobacter sp. ELB17 | 23845 | 43291 | 126665997/ 5290 | 126665996/ 5860 | 126665995/ 1024 | 126665993/ 3160 | 126665990/ 2109 | 126665989/ 4219 |
| Methanoplanu | 1594401 | 1624870 | missing | 374629430/ 5870 | 374629429/ 1035 | 374629424/ 3174 374629428/ 3175 | 374629423/ 2120 | 374629422/ 4230 |
| Methanoplanu | 2294064 | 2309549 | 374630020/ 5301 | 374630019/ 5871 | 374630018/ 1036 | 374630017/ 3176 | 374630014/ 2121 | 374630013/ 4231 |
| Methylophaga aminisulfidivorans MP | 75838 | 91891 | 335043949/ 5349 | 335043948/ 5920 | 335043947/ 1087 | 335043946/ 3228 | 335043943/ 2173 | 335043942/ 4280 |
| Oribacterium sp. ACB7 | 598004 | 613860 | 363897445/ 5296 | 363897444/ 5866 | 363897443/ 1030 | 363897440/ 3166 363897442/ 3167 | 363897438/ 2115 | 363897437/ 4225 |
| Oribacterium sp. ACB8 | 361812 | 375959 | 395208378/ 5337 | 395208454/ 5907 | 395208610/ 1074 | 395208247/ 3216 | 395208500/ 2160 | 395208399/ 4267 |
| Photobacterium sp. SKA34 | 74472 | 92346 | 89073849/ 5352 | 89073848/ 5923 | 89073847/ 1090 | 89073841/ 3231 | 89073839/ 2176 | 89073838/ 4283 |
| Proteus mirabilis WGLW6 | 764883 | 778479 | 425069874/ 5328 | 425069875/ 5897 | 425069876/ 1064 | 425069878/ 3206 | 425069879/ 2149 | 425069880/ 4258 |
| Pseudomonas fragi A22 | 86067 | 103151 | 402700379/ 5322 | 402700380/ 5891 | 402700381/ 1058 | 402700382/ 3200 | 402700385/ 2143 | 402700386/ 4253 |
| Pseudomonas fuscovaginae UPB0736 | 2117 | 19238 | 404399334/ 5331 | 404399333/ 5900 | 404399332/ 1067 | 404399331/ 3209 | 404399328/ 2152 | 404399327/ 4261 |
| Roseburia inulinivorans DSM 16841 | 2013 | 15569 | 225374528/ 5334 | 225374527/ 5903 | 225374526/ 1070 | 225374525/ 3212 | 225374523/ 2156 | 225374522/ 4263 |
| Salmonella enterica subsp. enterica serovar Enteritidi | 1280 | 14693 | 437842753/ 5292 | 437842752/ 5862 | 437842751/ 1026 | missing | 437842750/ 2111 | 437842749/ 4221 |
| Salmonella enterica subsp. enterica serovar Saintpau | 39286 | 52691 | 167551248/ 5335 | 167551249/ 5904 | 167551250/ 1071 | 167551251/ 3213 | 205357107/ 2157 | 167551253/ 4264 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Salmonella enterica subsp. enterica serovar Typhimuriu | 28163 | 43331 | 427646246/ 5330 | 427646245/ 5899 | 427646244/ 1066 | 427646243/ 3208 | 427646240/ 2151 | 427646239/ 4260 |
| Salmonella enterica subsp. enterica serovar Uganda str | 72 | 15632 | 417522348/ 5307 | 417522347/ 5877 | 417522346/ 1043 | 417522343/ 3183 417522344/ 3184 | 417522342/ 2128 | 417522341/ 4238 |
| Sinorhizobium meliloti CCNWSX0020 | 157136 | 171638 | 418398872/ 5320 | 418398871/ 5889 | 418398870/ 1056 | 418398867/ 3198 | 418398866/ 2141 | 418398865/ 4251 |
| Sphingobium yanoikuyae XLDN2-5 | 37182 | 50024 | 381199745/ 5321 | 381199746/ 5890 | 381199747/ 1057 | 381199748/ 3199 | 381199749/ 2142 | 381199750/ 4252 |
| Vibrio cholera CIRS 101 | 6477 | 19662 | 255743726/ 5304 | missing | 255743727/ 1039 | 255743728/ 3179 | 255743729/ 2124 | 255743730/ 4234 |
| Vibrio cholerae CP1035(8) | 131961 | 147079 | 422306078/ 5313 | 422306079/ 5882 | 422306080/ 1049 | 422306082/ 3191 | 422306083/ 2134 | 422306084/ 4244 |
| Vibrio cholerae HC-22A1 | 4662 | 17826 | 423152696/ 5360 | 423152697/ 5931 | 423152698/ 1098 | 423152699/ 3240 | 423152700/ 2184 | 423152701/ 4291 |
| Vibrio cholerae HC-23A1 | 7323 | 20508 | 418336064/ 5359 | 418336065/ 5930 | 418336066/ 1097 | 418336067/ 3239 | 418336068/ 2183 | 418336069/ 4290 |
| Vibrio cholerae HC-28A1 | 4645 | 17830 | 418342900/ 5302 | 418342901/ 5872 | 418342902/ 1037 | 438342903/ 3177 | 418342904/ 2122 | 418342905/ 4232 |
| Vibrio cholerae HC-32A1 | 4645 | 17830 | 423155502/ 5340 | 423155503/ 5910 | 423155504/ 1077 | 423155505/ 3218 | 423155506/ 2163 | 423155507/ 4270 |
| Vibrio cholerae HC-40A1 | 594 | 12995 | missing | 422890702/ 5917 | 422890703/ 1084 | 422890704/ 3225 | 422890705/ 2170 | 422890706/ 4277 |
| Vibrio cholerae HC-47A1 | 4639 | 17824 | 424621185/ 5345 | 424621186/ 5915 | 424621187/ 1082 | 424621188/ 3223 | 424621189/ 2168 | 424621190/ 4275 |
| Vibrio cholerae HC-48B2 | 547 | 12948 | missing | 423164023/ 5876 | 423164024/ 1042 | 423164025/ 3182 | 423164026/ 2127 | 423164027/ 4237 |
| Vibrio cholerae HC-55B2 | 56848 | 70060 | 424015508/ 5348 | 424015509/ 5919 | 424015510/ 1086 | 424015511/ 3227 | 424015512/ 2172 | 424015513/ 4279 |
| Vibrio cholerae HC-60A1 | 56864 | 70076 | 423878984/ 5318 | 423878985/ 5887 | 423878986/ 1054 | 423878987/ 3196 | 423878988/ 2139 | 423878989/ 4249 |
| Vibrio cholerae HC-61A2 | 57077 | 70289 | 419832015/ 5308 | missing | 419832016/ 1044 | 419832017/ 3185 | 419832018/ 2129 | 419832019/ 4239 |
| Vibrio cholerae HC-68A1 | 4639 | 17824 | 443514284/ 5324 | 443514285/ 5893 | 443514286/ 1060 | 443514287/ 3202 | 443514288/ 2145 | 443514289/ 4254 |
| Vibrio cholerae HC-71A1 | 4637 | 17822 | 443518098/ 5305 | 443518099/ 5874 | 443518100/ 1040 | 443518101/ 3180 | 443518102/ 2125 | 443518103/ 4235 |
| Vibrio cholerae HC-80A1 | 4635 | 17820 | 443534356/ 5333 | 443534357/ 5902 | 443534358/ 1069 | 443534359/ 3211 | 443534360/ 2155 | 443534361/ 4262 |
| Vibrio cholerae HC-81A2 | 4631 | 17816 | 424655756/ 5288 | 424655757/ 5858 | 424655758/ 1022 | 424655759/ 3158 | 424655760/ 2107 | 424655761/ 4217 |
| Vibrio cholerae HCUF01 | 7324 | 20488 | 417815509/ 5315 | 417815510/ 5884 | 417815511/ 1051 | 417815512/ 3193 | 417815513/ 2136 | 417815514/ 4246 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Vibrio cholerae MO10 | 324004 | 339140 | 254850926/ 5314 | 254850927/ 5883 | 254850928/ 1050 | 254850931/ 3192 | 254850932/ 2135 | 254850933/ 4245 |
| Vibrio cholerae O1 str. EC-0012 | 4654 | 17839 | 472152150/ 5297 | 472152151/ 5867 | 472152152/ 1031 | 472152153/ 3168 | 472152154/ 2116 | 472152155/ 4226 |
| Vibrio cholerae O1 str. EM-1546 | 4648 | 17833 | 472383764/ 5287 | 472183765/ 5857 | 472183766/ 1021 | 472183767/ 3157 | 472183768/ 2106 | 472183769/ 4216 |
| Vibrio cholerae O1 str. NHCC-006C | 4648 | 17833 | 472202869/ 5351 | 472202870/ 5922 | 472202871/ 1089 | 472202872/ 3230 | 472202873/ 2175 | 472202874/ 4282 |
| Vibrio cholerae HC-20A2 | 44947 | 58111 | 421338424/ 5362 | 421338423/ 5933 | 421338422/ 1100 | 421338421/ 3242 | 421338420/ 2186 | 421338419/ 4292 |
| Vibrio cholerae HC-21A1 | 42267 | 55452 | 423147143/ 5311 | 423147142/ 5880 | 423147141/ 1047 | 423147140/ 3189 | 423147139/ 2132 | 423147138/ 4242 |
| Vibrio cholerae HC-42A1 | 42245 | 55430 | 424618577/ 5353 | 424618576/ 5924 | 424618575/ 1091 | 424618574/ 3232 | 424618573/ 2177 | 424618572/ 4284 |
| Vibrio cholerae HC-51A1 | 58485 | 71697 | 424630791/ 5300 | missing | 424630790/ 1034 | 424630789/ 3173 | 424630788/ 2119 | 424630787/ 4229 |
| Xanthomonas vesicatoria ATCC 35937 | 3685 | 17230 | missing | 325918008/ 5934 | 325918007/ 1101 | 325918006/ 3243 | 325918004/ 2187 | 325918003/ 4293 |
| Acetivibrio cellulolyticus CD2 | 169996 | 184667 | 366164462/ 5174 | 366164461/ 5766 | 366164460/ 893 | 366164459/ 3031 | 366164456/ 1982 | 366164455/ 4105 |
| Acinetobacter baumannii AB5256 | 10653 | 23830 | 457996552/ 5162 | 457996553/ 5755 | 457996554/ 880 | 457996555/ 3018 | 457996556/ 1969 | 457996557/ 4092 |
| Acinetobacter baumannii Naval-18 | 55392 | 70524 | 417550475/ 5190 | 417550474/ 5780 | 417550828/ 910 | 417550745/ 3049 | 417551043/ 1999 | 417550931/ 4120 |
| Acinetobacter johnsonii SH046 | 37452 | 52595 | 262371249/ 5119 | 262371248/ 5720 | 262371247/ 836 | 262371246/ 2974 | 262371244/ 1925 | 262371243/ 4052 |
| Acinetobacter junii SH205 | 131814 | 145059 | 262374463/ 5121 | 262374464/ 5722 | 262374465/ 838 | 262374466/ 2976 | 262374467/ 1927 | 262374468/ 4053 |
| Acinetobacter lwoffii SH145 | 39119 | 53440 | 262377711/ 5181 | 262377712/ 5772 | 262377713/ 901 | 262377714/ 3039 262377715/ 3040 | 262377716/ 1990 | 262377717/ 4031 |
| Acinetobacter radioresistens DSM 6976 = NBRC 102413 | 6083 | 19313 | 421857671/ 5141 | 421857672/ 5738 | 421857673/ 859 | 421857674/ 2996 | 421857675/ 1948 | 421857676/ 4073 |
| Acinetobacter sp. SH024 | 10059 | 24620 | 293611304/ 5184 | 293611305/ 5775 | 293611306/ 904 | 293611307/ 3043 | 293611309/ 1993 | 293611310/ 4114 |
| Actinomyces sp. ICM47 | 13893 | 28963 | 396584771/ 5102 | 396584768/ 5703 | 396584764/ 818 | 396584767/ 2954 | 396584777/ 6204 | 396584762/ 4036 |
| Actinomyces sp. oral taxon 178 str | 1582915 | 1598023 | 320095079/ 5139 | 320095080/ 5735 | 320095081/ 857 | 320095082/ 2994 | 320095085/ 1946 | 320095086/ 4072 |
| Alcanivorax pacificus W11-5 | 73364 | 89677 | 407801754/ 5128 | 407801755/ 5727 | 407801756/ 845 | 407801760/ 2982 | 407801761/ 1934 | 407801762/ 4060 |
| Alcanivorax sp. DG881 | 3121028 | 3136375 | 254429639/ 5165 | 254427953/ 5758 | 254428479/ 883 | 254429762/ 3022 | 254428445/ 1972 | 254426952/ 4095 |

TABLE 10-continued

| Organism | Genomic Start Point | Genomic End Point | brxA* | brxB* | brxC* | pglX* | pglZ* | brxL* |
|---|---|---|---|---|---|---|---|---|
| Bacillus cereus BAG6X1-2 | 790081 | 800966 | 423480947/ 5252 | 423480948/ 5831 | 423480949/ 976 | 423480950/ 3116 | 423480951/ 2065 | Missing |
| Bacillus cereus HuB2-9 | 3250049 | 3263169 | 423535446/ 5246 | 423535445/ 5826 | 423535444/ 969 | 423535443/ 3108 | 423535442/ 2058 | 423535441/ 4173 |
| Bacteroides coprophilus DSM 18228 | 12964

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Desulfotomaculum gibsoniae DS | 100510 | 112411 | 357040623/ 5211 | 357040624/ 5796 | 357040625/ 932 | 357040626/ 3072 | 357040629/ 2021 | Missing |
| Enterobacter sp. SST3 | 61939 | 75308 | 401676813/ 5243 | 401676814/ 5824 | 401676815/ 966 | 401676816/ 3105 | 401676817/ 2055 | 401676818/ 4170 |
| Enterococcus faecalis TX0109 | 21896 | 38028 | 307287298/ 5132 | 307287299/ 5730 | 307287300/ 850 | 307287301/ 2987 | 307287305/ 1939 | 307287306/ 4065 |
| Enterococcus faecalis TX1302 | 21900 | 38032 | 422702471/ 5237 | 422702472/ 5820 | 422702473/ 960 | 422702474/ 3099 | 422702478/ 2049 | 422702479/ 4164 |
| Enterococcus faecium 509 | 9609 | 22964 | 425047892/ 5407 | 425047891/ 5797 | 425047890/ 934 | 425047889/ 3074 | 425047888/ 2023 | 425047887/ 4141 |
| Enterococcus faecium 514 | 192 | 13547 | 425034027/ 5164 | 425034028/ 5757 | 425034029/ 882 | 425034030/ 3021 | 425034031/ 1971 | 425034032/ 4094 |
| Enterococcus faecium C1904 | 5282 | 18637 | 425024182/ 5405 | 425024181/ 5785 | 425024180/ 916 | 425024179/ 3056 | 425024178/ 2005 | 425024177/ 4126 |
| Enterococcus faecium C497 | 142 | 13497 | 425019537/ 5151 | 425019538/ 5745 | 425019539/ 869 | 425019540/ 3006 | 425019541/ 1958 | 425019542/ 4030 |
| Enterococcus faecium E0679 | 308557 | 323090 | 430834457/ 5187 | 430834456/ 5777 | 430834455/ 907 | 430834454/ 3046 | 430834452/ 1996 | 430834451/ 4117 |
| Enterococcus faecium E1904 | 314134 | 328775 | 431640912/ 5265 | 431640911/ 5841 | 431640910/ 990 | 431640909/ 3133 | 431639958/ 2079 | 431639957/ 4191 |
| Enterococcus faecium ERV99 | 5283 | 18638 | 424979863/ 5399 | 424979862/ 5709 | 424979861/ 824 | 424979860/ 2960 | 424979859/ 1912 | 424979858/ 4041 |
| Enterococcus faecium P1123 | 191 | 13546 | 424977969/ 5203 | 424977970/ 5792 | 424977971/ 924 | 424977972/ 3064 | 424977973/ 2013 | 424977974/ 4132 |
| Enterococcus faecium P1137 | 5282 | 18637 | 424974922/ 5414 | 424974921/ 5848 | 424974920/ 1001 | 424974919/ 3144 | 424974918/ 2090 | 424974917/ 4202 |
| Enterococcus faecium P1139 | 191 | 13546 | 424971162/ 5204 | 424971163/ 5793 | 424971164/ 925 | 424971165/ 3065 | 424971166/ 2014 | 424971167/ 4133 |
| Enterococcus faecium TX0133A | 9607 | 22962 | 314950597/ 5404 | 314950596/ 5768 | 314950595/ 895 | 314950594/ 3033 | 314950593/ 1984 | 314950592/ 4106 |
| Enterococcus faecium TX0133a01 | 192 | 13547 | 314996683/ 5244 | 314996684/ 5825 | 314996685/ 967 | 314996686/ 3106 | 314996687/ 2056 | 314996688/ 4171 |
| Enterococcus faecium TX0133a04 | 9609 | 22964 | 314939181/ 5409 | 314939180/ 5827 | 314939179/ 970 | 314939178/ 3109 | 314939177/ 2059 | 314939176/ 4174 |
| Enterococcus faecium TX0133B | 9609 | 22964 | 314992451/ 5408 | 314992450/ 5804 | 314992449/ 941 | 314992448/ 3081 | 314992447/ 2030 | 314992446/ 4147 |
| Escherichia coli 2534-86 | 70489 | 83934 | 417589503/ 5275 | 417589502/ 5849 | 417589501/ 1002 | 417589499/ 3145 417589500/ 3146 | 417589498/ 2091 | 417589497/ 4203 |
| Escherichia coli 3.3884 | 1217008 | 1230445 | 417270173/ 5116 | 417270040/ 5717 | 417269258/ 833 | 417268711/ 2970 | 417269719/ 1922 | 417270270/ 4049 |
| Escherichia coli 96.154 | 246141 | 259589 | 417223908/ 5285 | 417224699/ 5854 | 417224010/ 1016 417225258/ 1017 | 417225276/ 3155 | 417224519/ 2102 | 417225329/ 4213 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Escherichia coli DEC10E | 318305 | 331717 | 419281130/ 5118 | 419281129/ 5719 | 419281128 | 419281126/ 2972 419281127/ 2973 | 419281125/ 1924 | 419281124/ 4051 |
| Escherichia coli DEC10F | 147401 | 160847 | 419281503/ 5225 | 419281502/ 5809 | 419281501 | 419281500/ 3088 | 419281499/ 2037 | 419281498/ 4154 |
| Escherichia coli DEC13B | 92227 | 105618 | 419352610/ 5284 | 419352609/ 5853 | 419352607/ 1014 419352608/ 1015 | 419352604/ 3153 419352606/ 3154 | 419352603/ 2101 | 419352602/ 4212 |
| Escherichia coli DEC13C | 68089 | 81481 | 419358139/ 5283 | 419358138/ 5852 | 419358136/ 1012 419358137/ 1013 | 419358134/ 3151 419358135/ 3152 | 419358133/ 2100 | 419358132/ 4211 |
| Escherichia coli DEC13D | 138809 | 154330 | 419363104/ 5277 | 419363100/ 5850 | 419363098/ 1004 419363099/ 1005 | 419363096/ 3147 419363097/ 3148 | 419363095/ 2093 | 419363094/ 4205 |
| Escherichia coli DEC14B | 143274 | 156684 | 419378584/ 5250 | 419378583/ 5829 | 419378582/ 974 | 419378580/ 3113 419378581/ 3114 | 419378578/ 2063 | 419378576/ 4178 |
| Escherichia coli DEC14D | 9353 | 22765 | 419389188/ 5156 | 419389187/ 5749 | 419389186/ 874 | 419389184/ 3011 419389185/ 3012 | 419389183/ 1963 | 419389182/ 4086 |
| Escherichia coli DEC7B | 11328 | 24717 | 419173689/ 5109 | 419173698/ 5710 | 419173682/ 826 | 419173671/ 2962 | 419173696/ 1914 | 419173675/ 4043 |
| Escherichia coli DEC8A | 78187 | 91632 | 419200151/ 5200 | 419200150/ 5790 | 419200149/ 921 | 419200148/ 3061 | 419200147/ 2010 | 419200146/ 4130 |
| Escherichia coli DEC8B | 18788 | 33547 | 419206519/ 5227 | 419206636/ 5811 419206666/ 5812 | 419206641/ 950 | 419206658/ 3090 | 419206669/ 2039 | 419206621/ 4156 |
| Escherichia coli DEC9B | 139979 | 153424 | 419235451/ 5124 | 419235547/ 5724 | 419235503/ 841 | 419235607/ 2979 419235615/ 2980 | 419235606/ 1930 | 419235530/ 4056 |
| Escherichia coli DEC9E | 26957 | 40402 | 419252319/ 5261 | 419252318/ 5838 | 419252317/ 985 | 419252315/ 3127 419252316/ 3128 | 419252314/ 2074 | 419252313/ 4187 |
| Escherichia coli JB1-95 | 70264 | 85023 | 417209283/ 5267 | 417209341/ 5842 | 417209350/ 992 | 417209346/ 3135 | 417209331/ 2081 | 417209313/ 4193 |
| Escherichia coli KD2 | 14059 | 28959 | 419919262/ 5403 | 419919261/ 5761 | 419919260/ 888 | 419919259/ 3027 | 419919256/ 1977 | 419919255/ 4100 |

TABLE 10-continued

| Organism | Genomic Start Point | Genomic End Point | brxA* | brxB* | brxC* | pglX* | pglZ* | brxL* |
|---|---|---|---|---|---|---|---|---|
| Escherichia coli KTE12 | 333731 | 347168 | 432379522/ 5106 | 432379521/ 5707 | 432379520/ 822 | 432379519/ 2958 | 432379518/ 1910 | 432379517/ 4039 |
| Escherichia coli KTE139 | 791 | 14168 | 433099196/ 5154 | 433099195/ 5748 | 433099194/ 872 | 433099193/ 3009 | 433099192/ 1961 | 433099191/ 4084 |
| Escherichia coli KTE153 | 3821 | 17182 | 433118462/ 5401 | 433118461/ 5729 | 433118460/ 849 | 433118459/ 2986 | 433118458/ 1938 | 433118457/ 4064 |
| Escherichia coli KTE211 | 421523 | 434900 | 432983125/ 5161 | 432983126/ 5754 | 432983127/ 879 | 432983128/ 3017 | 432983129/ 1968 | 432983130/ 4091 |
| Escherichia coli KTE218 | 593208 | 606594 | 432993615/ 5198 | 432993616/ 5788 | 432993617/ 919 | 432993618/ 3059 | 432993619/ 2008 | 432993620/ 4128 |
| Escherichia coli KTE234 | 445622 | 459002 | 432531967/ 5239 | 432531966/ 5822 | 432531965/ 962 | 432531964/ 3101 | 432531963/ 2051 | 432531962/ 4166 |
| Escherichia coli KTE47 | 290106 | 305021 | 432551900/ 5233 | 432551901/ 5816 | 432551902/ 956 | 432551903/ 3095 | 432551906/ 2045 | 432551907/ 4161 |
| Escherichia coli KTE53 | 325634 | 339020 | 432566734/ 5264 | 432566735/ 5840 | 432566736/ 989 | 432566737/ 3132 | 432566738/ 2078 | 432566739/ 4190 |
| Escherichia coli KTE6 | 789918 | 803295 | 432708021/ 5183 | 432708022/ 5774 | 432708023/ 903 | 432708024/ 3042 | 432708025/ 1992 | 432708026/ 4113 |
| Escherichia coli MS 69-1 | 8280 | 23192 | 301024309/ 5147 | 301024308/ 5742 | 301024307/ 865 | 301024306/ 3002 | 301024303/ 1954 | 301024302/ 4079 |
| Escherichia coli O10:K5(L)H4 str. ATCC 23506 | 1722 | 15111 | 442594978/ 5159 | 442594979/ 5752 | 442594980/ 877 | 442594981/ 3015 | 442594982/ 1966 | 442594983/ 4089 |
| Escherichia coli O111:H8 str. CVM9570 | 43889 | 57335 | 419887469/ 5220 | 419887468/ 5806 | 419887467/ 943 | 419887466/ 3083 | 419887465/ 2032 | 419887464/ 4149 |
| Escherichia coli O111:H8 str. CVM9634 | 13485 | 26931 | 420093467/ 5134 | 420093468/ 5732 | 420093469/ 852 | 420093470/ 2989 | 420093471/ 1941 | 420093472/ 4067 |
| Escherichia coli O113:H21 str. CL-3 | 111648 | 125096 | 458688575/ 5271 | 458688574/ 5844 | 458688573/ 996 | 458688572/ 3139 458688570/ 4197 | 458688571/ 2085 | 458688570/ 4197 |
| Escherichia coli O25b:ST131 str. JIE186 | 179 | 13555 | 458890352/ 5163 | 458890353/ 5756 | 458890354/ 881 | 483041219/ 3019 481041220/ 3020 | 458890355/ 1970 | 458890356/ 4093 |
| Escherichia coli OK1180 | 263790 | 277236 | 415823690/ 5194 | 415823689/ 5784 | 415823688/ 914 | 415823687/ 3054 | 415823686/ 2003 | 415823685/ 4124 |
| Escherichia coli S17 | 4631 | 19699 | 450256213/ 5168 | 450256210/ 5759 | 450256209/ 886 | 450256207/ 3025 | 450256206/ 1975 | 450256205/ 4098 |
| Escherichia coli STEC_94C | 133003 | 146449 | 417605265/ 5113 | 417605264/ 5714 | 417605263/ 830 | 417605261/ 2966 417605262/ 2967 | 417605260/ 1919 | 417605259/ 4046 |
| Escherichia coli TW10828 | 209301 | 222747 | 458059912/ 5138 | 458059911/ 5734 | 458059910/ 856 | 458059909/ 2993 | 458059908/ 1945 | 458059907/ 4071 |
| Eubacterium cellulosolvens 6 | 2986470 | 3002126 | 389577853/ 5216 | 389577852/ 5801 | 389577851/ 938 | 389577850/ 3078 | 389577845/ 2027 | Missing |
| Faecalibacterium prausnitzii A2-165 | 463318 | 476823 | 257438028/ 5192 | 257438027/ 5782 | 257438026/ 912 | 257438025/ 3052 | 257438023/ 2001 | 257438022/ 4122 |

TABLE 10-continued

| Organism | Genomic Start Point | Genomic End Point | brxA* | brxB* | brxC* | pglX* | pglZ* | brxL* |
|---|---|---|---|---|---|---|---|---|
| | | | | BREX type 1 systems | | | | |
| Fulvimarina pelagi HTCC2506 | 98942 | 111984 | 114706333/ 5193 | 114706332/ 5783 | 114706331/ 913 | 114706330/ 3053 | 114706329/ 2002 | 114706328/ 4123 |
| Fusobacterium necrophorum subsp | 564908 | 579712 | 373113611/ 5140 | 373113608/ 5736 373113609/ 5737 | 373113625/ 858 | 373113618/ 2995 | 373113613/ 1947 | Missing |
| Fusobacterium nucleatum subsp. nucleatum ATCC 23726 | 33577 | 58056 | 296328615/ 5179 | 296328614/ 5770 | 296328627/ 899 | 296328621/ 3037 | 296328617/ 1988 | 296328616/ 4110 |
| Fusobacterium sp. 11_3_2 | 557323 | 577812 | 336418217/ 5188 | 336418218/ 5778 | 336418208/ 908 | 336418211/ 3047 | 336418215/ 1997 | 336418216/ 4118 |
| Fusobacterium sp. 3_1_27 | 1001099 | 1027629 | 294785575/ 5180 | 294785574/ 5771 | 294785588/ 900 | 294785585/ 3038 | 294785577/ 1989 | 294785576/ 4111 |
| Fusobacterium sp. 3_1_5R | 242664 | 257240 | 317058273/ 5175 | 317058274/ 5767 | 317058268/ 894 | 317058270/ 3032 | 317058272/ 1983 | Missing |
| Fusobacterium ulcerans ATCC 49185 | 320598 | 335972 | 404368581/ 5223 | 404368582/ 5807 | 404368577/ 946 | 404368578/ 3086 | 404368579/ 2035 | 404368580/ 4152 |
| gamma proteobacterium BDW918 | 205372 | 220880 | 386288256/ 5172 | 386288257/ 5764 | 386288258/ 891 | 386288262/ 3030 | 386288263/ 1980 | 386288264/ 4103 |
| gamma proteobacterium IMCC3088 | 77590 | 90394 | 329896084/ 5131 | 329896083/ 5728 | 329896082/ 848 | 329896081/ 2985 | 329896080/ 1937 | 329896079/ 4063 |
| Geobacillus sp. G11MC16 | 128797 | 142893 | 196250359/ 5232 | 196250358/ 5815 | 196250357/ 955 | 196250356/ 3094 | 196250354/ 2044 | Missing |
| Geobacillus thermoglucosidan | 1816670 | 1827544 | 423719991/ 5201 | 423719992/ 5791 | 423719993/ 922 | 423719994/ 3062 | 423719995/ 2011 | Missing |
| Glaciecola polaris LMG 21857 | 41332 | 52442 | 410618148/ 5280 | 196250358/ 5815 | 410618146/ 1008 | 410618145/ 3150 | 410618144/ 2097 | Missing |
| Glaciecola punicea DSM 14233 = ACAM 611 | 141624 | 156305 | 381395614/ 5236 | 381395615/ 5819 | 381395616/ 959 | 381395619/ 3098 | 381395620/ 2048 | 381395621/ 4033 |
| Haloarcula japonica DSM 6131 | 437852 | 452733 | 448689859/ 5254 | 448689858/ 5833 | 448689857/ 978 | 448689855/ 3119 | 448689853/ 2067 | 448689852/ 4180 |
| Halomonas sp. HAL1 | 3095 | 24448 | 352101114/ 5125 | 352101113/ 5725 | 352101112/ 842 | 5′ of gene missing | 352101104/ 1931 | 352101103/ 4057 |
| Holdemania filiformis DSM 12042 | 5004 | 17955 | 223986440/ 5186 | 223986439/ 5776 | 223986438/ 906 | 223986437/ 3045 | 223986436/ 1995 | 223986435/ 4116 |
| Holophaga foetida DSM 6591 | 8075 | 23271 | 373485785/ 5115 | 373485786/ 5716 | 373485787/ 832 | 373485789/ 2969 | 373485791/ 1921 | 373485792/ 4048 |
| Johnsonella ignava ATCC 51276 | 86362 | 100649 | 358066716/ 5240 | 358066715/ 5823 | 358066714/ 963 | 358066713/ 3102 | 358066709/ 2052 | 358066708/ 4167 |
| Lachnoanaerobaculum (Eubacterium) saburreum DSM 3986 | 1084944 | 1098333 | 315651036/ 5406 | 315651037/ 5944 | 315651038/ 1172 | 315651039/ 3278 | 315651043/ 2248 | 315651044/ 4024 |
| Lachnoanaerobaculum (Eubacterium) saburreum F0468 | 2724 | 17869 | 419720906/ 5400 | 419720918/ 5944 | 419720908/ 1170 | 419720916/ 3276 | 419720919/ 2248 | 419720903/ 4020 |

TABLE 10-continued

| Organism | Genomic Start Point | Genomic End Point | BREX type 1 systems ||||||
|---|---|---|---|---|---|---|---|---|
| | | | brxA* | brxB* | brxC* | pglX* | pglZ* | brxL* |
| Lachnospiraceae bacterium 1_1_57FAA | 88155 | 102869 | 336440367/ 5105 | 336440366/ 5706 | 336440365/ 821 | 336440363/ 2957 | 336440358/ 1909 | Missing |
| Lachnospiraceae bacterium 8_1_57FAA | 229861 | 244575 | 317501016/ 5148 | 317501017/ 5743 | 317501018/ 866 | 317501020/ 3003 | 317501025/ 1955 | Missing |
| Lachnospiraceae oral taxon 107 str | 111528 | 132974 | 331001729/ 5110 | 331001730/ 5711 | 331001731/ 827 | 331001734/ 2963 | 331001737/ 1915 331001745/ 1916 | Missing |
| Lactobacillus casei Lpc-37 | 1267 | 17585 | 418013531/ 5182 | 418013530/ 5773 | 418013529/ 902 | 418013528/ 3041 | 418013525/ 1991 | 418013524/ 4112 |
| Lactobacillus rhamnosus LRHMDP2 | 142681 | 159146 | 421768513/ 5255 | 421768512/ 5834 | 421768511/ 979 | 421768508/ 3120 421768510/ 3121 | 421768507/ 2068 | 421768506/ 4181 |
| Lactobacillus rhamnosus LRHMDP3 | 129821 | 146256 | 421772571/ 5253 | 421772572/ 5832 | 421772573/ 977 | 421772574/ 3117 421772576/ 3118 | 421772577/ 2066 | 421772578/ 4035 |
| Lactobacillus johnsonii ATCC 33200 | 547785 | 564068 | 227889974/ 5196 | 227889975/ 5786 | 227889976/ 917 | 227889977/ 3057 | 227889982/ 2006 | Missing |
| Lactobacillus reuteri CF48-3A | 141036 | 153317 | 227544819/ 5411 | 227544818/ 5839 | 227544817/ 986 | 227544816/ 3129 | 227544813/ 2075 | Missing |
| Microcystis aeruginosa PCC 9443 | 76626 | 89380 | missing | 425444979/ 5856 | 425444980/ 1020 | 425444983/ 3156 | 425444986/ 2105 | Missing |
| Nitratireductor indicus C115 | 129343 | 142197 | 407974990/ 5160 | 407974989/ 5753 | 407974988/ 878 | 407974987/ 3016 | 407974986/ 1967 | 407974985/ 4090 |
| Opitutacea | 241740 | 261922 | 373849354/ 5279 | missing | 373849352/ 1007 | missing | 373849343/ 2096 | 373849342/ 4208 |
| Oribacterium sp. ACB1 | 648540 | 662687 | 363899397/ 5117 | 363899396/ 5718 | 363899395/ 834 | 363899394/ 2971 | 363899392/ 1923 | 363899391/ 4050 |
| Paenibacillus elgii B69 | 3761 | 16828 | 357010164/ 5226 | 357010163/ 5810 | 357010162/ 949 | 357010161/ 3089 | 357010160/ 2038 | 357010159/ 4155 |
| Pantoea sp. GM01 | 181180 | 196279 | 398800469/ 5153 | 398800470/ 5747 | 398800471/ 871 | 398800472/ 3008 | 398800475/ 1960 | 398800476/ 4083 |
| Parabacteroides sp. D25 | 349829 | 371928 | 410103031/ 5146 | 410103030/ 5741 | 410103029/ 864 | 410103028/ 3001 | 410103021/ 1953 | 410103020/ 4078 |
| Pectobacterium wasabiae CFBP 3304 | 12026 | 27179 | 421082308/ 5112 | 421082307/ 5713 | 421082306/ 829 | 421082305/ 2965 | 421082302/ 1918 | 421082301/ 4045 |
| Pseudanabaena biceps PCC 7429 | 21843 | 38743 | 443475022/ 5135 | 443475021/ 5733 | 443475020/ 853 | 443475017/ 2990 | 443475015/ 1942 | 443475014/ 4068 |
| Pseudoalteromona | 80528 | 95485 | 409203052/ 5238 | 409203051/ 5821 | 409203050/ 961 | 409203049/ 3100 | 409203047/ 2050 | 409203046/ 4165 |
| Pseudoalteromonas luteoviolacea B = ATCC 29581 | 7985 | 26765 | 442610065/ 5217 | 442610064/ 5802 | 442610063/ 939 | 442610062/ 3079 | 442610058/ 2028 | 442610057/ 4145 |
| Pseudomonas mandelii JR-1 | 1337696 | 1354409 | 407366557/ 5228 | 407366556/ 5813 | 407366555/ 951 | 407366548/ 2040 | 407366548/ 2040 | 407366547/ 4157 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Pseudomonas psychrotolerans L19 | 141817 | 157158 | 359780192/ 5173 | 359780191/ 5765 | 359780190/ 892 | missed by ORF finder tool | 359780188/ 1981 | 359780187/ 4104 |
| Pseudomonas syringae Lz4W | 83306 | 107608 | 470894104/ 5133 | 470894103/ 5731 | 470894102/ 851 | 470894100/ 2988 | 470894093/ 1940 | 470894092/ 4066 |
| Roseobacter sp. MED 193 | 2039740 | 2052609 | 86139888/ 5224 | 86139887/ 5808 | 86139886/ 947 | 86139885/ 3087 | 86139884/ 2036 | 86139883/ 4153 |
| Ruminococcaceae bacterium D16 | 39789 | 54066 | 332655416/ 5114 | 332655415/ 5715 | 332655414/ 831 | 332655413/ 2968 | 332655411/ 1920 | 332655410/ 4047 |
| Salmonella enterica subsp. enterica serovar Infantis | 4758712 | 4773847 | 375004441/ 5111 | 375004440/ 5712 | 375004439/ 828 | 375004438/ 2964 | 375004435/ 1917 | 375004434/ 4044 |
| Salmonella enterica serovar Typhimurium STm1 uid181283 | 116457 | 131625 | 422028739/ 5158 | 422028738/ 5751 | 422028737/ 876 | 422028736/ 3014 | 422028733/ 1965 | 422028732/ 4088 |
| Salmonella enterica serovar Typhimurium ST1660 06 uid190371 | 348410 | 363578 | 458765354/ 5170 | 458765353/ 5762 | 458765352/ 889 | 458765351/ 3028 | 458765348/ 1978 | 458765347/ 4101 |
| Salmonella enterica serovar Typhimurium STm2 uid181284 | 28160 | 43328 | 422033790/ 5177 | 422033789/ 5769 | 422033788/ 897 | 422033787/ 3035 | 422033784/ 1986 | 422033783/ 4108 |
| Salmonella enterica serovar Typhimurium STm3 uid181357 | 30253 | 45421 | 427597642/ 5215 | 427597641/ 5800 | 427597640/ 937 | 427597639/ 3077 | 427597636/ 2026 | 427597635/ 4144 |
| Salmonella enterica serovar Typhimurium STm8 uid181355 | 28155 | 43323 | 427557943/ 5234 | 427557942/ 5817 | 427557941/ 957 | 427557940/ 3096 | 427557937/ 2046 | 427557936/ 4162 |
| Salmonella enterica serovar Typhimurium STm12 uid181362 | 30250 | 45412 | 427682142/ 5251 | 427682141/ 5830 | 427682140/ 975 | 427682139/ 3115 | 427682136/ 2064 | 427682135/ 4179 |
| Salmonella enterica serovar Typhimurium STm4 uid181358 | 28233 | 43401 | 427622026/ 5256 | 427622025/ 5835 | 427622024/ 980 | 427622023/ 3122 | 427622020/ 2069 | 427622019/ 4182 |
| Salmonella enterica serovar Typhimurium STm9 uid181356 | 28172 | 43334 | 427576011/ 5260 | 427576010/ 5837 | 427576009/ 984 | 427576008/ 3126 | 427576005/ 2073 | 427576004/ 4186 |
| Salmonella enterica serovar Typhimurium STm11 uid181361 | 28220 | 43388 | 427658747/ 5274 | 427658746/ 5847 | 427658745/ 1000 | 427658744/ 3143 | 427658741/ 2089 | 427658740/ 4201 |
| Salmonella enterica serovar Typhimurium STm11 uid181361 | 28164 | 42133 | missing | missing | 427664029/ 1175 | 427664028/ 3149 | 427664025/ 2094 | 427664024/ 4206 |
| Salmonella enterica subsp. enterica serovar 4,[5],12:i:-str. CVM23701 | 105150 | 120318 | 167991286/ 5247 | 167991285/ 5828 | 167991284/ 971 | 167991283/ 3110 | 167991280 | 167991279/ 4175 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Selenomonas sputigena ATCC 35185 | 547454 | 560116 | 260887941/ 5120 | 260887940/ 5721 | 260887939/ 837 | 260887938/ 2975 | 260887934/ 1926 | 260887934/ truncated |
| Shewanella baltica OS625 | 211735 | 229091 | 418024977/ 5122 | 418024978/ 5723 | 418024979/ 839 | 418024983/ 2977 | 418024984/ 1928 | 418024985/ 4054 |
| Sphingobium indicum B90A | 80766 | 95394 | 390169179/ 5268 | 390169178/ 5843 | 390169177/ 993 | 390169174/ 3136 | 390169173/ 2082 | 390169172/ 4194 |
| Sporolactobacillus vineae DSM 21990 = SL153 | 5785 | 18771 | 404330921/ 5413 | 404330920/ 5845 | 404330919/ 997 | 404330918/ 3140 | 404330917/ 2086 | 404330916/ 4198 |
| Sporosarcina newyorkensis 2681 | 827385 | 843078 | 340357063/ 5206 | 340357064/ 5795 | 340357065/ 927 | 340357066/ 3067 | 340357070/ 2016 | 340357071/ 4135 |
| Stomatobaculum longum (Lachnospiraceae bacterium ACC2) | 64338 | 77737 | 373106083/ 5410 | 373106084/ 5946 | 373106085/ 1173 | 373106086/ 3279 | 373106087/ 1905 | 373106088/ 4034 |
| Stomatobaculum longum (Lachnospiraceae bacterium ACC2) | 21037 | 34636 | 373106631/ 5412 | 373106630/ 5947 | 373106629/ 1174 | 373106628/ 3280 | 373106623/ 1906 | Missing |
| Streptomyces sp. SPB78 | 3417840 | 3430694 | 302520235/ 5273 | 302520234/ 5846 | 302520233/ 999 | 302520232/ 3142 | 302520231/ 2088 | 302520230/ 4200 |
| Thiorhodovibrio sp. 970 | 1742073 | 1757839 | 381159244/ 5286 | Thi970DRAFT_ 2972/5701 | 381159246/ 1018 | Thi970DRAFT_ 2976/6182 | 381159257/ 2103 | 381159258/ 4214 |
| Thiothrix nivea DSM 5205 | 4299231 | 4317524 | 386818309/ 5197 | 386818310/ 5787 | 386818311/ 918 | 386818316/ 3058 | 386818318/ 2007 | 386818319/ 4127 |
| Vibrio cholerae 4260B | 149276 | 164412 | 440708890/ 5229 | 440708891/ 5814 | 440708892/ 952 | 440708895/ 3091 | 440708896/ 2041 | 440708897/ 4158 |
| Vibrio cholerae B33 | 48656 | 63703 | 229509128/ 5205 | 229509127/ 5794 | 229509126/ 926 | 229509124/ 3066 | 229509123/ 2015 | 229509122/ 4134 |
| Vibrio cholerae B33 | 82818 | 97865 | 153821444/ 5219 | 153821461/ 5805 | 153821425/ 942 | 153821428/ 3082 | 153821427/ 2031 | 153821414/ 4148 |
| Vibrio cholerae CP1048(21) | 7472 | 20636 | 421334488/ 5245 | missing | 421334490/ 968 | 421334491/ 3107 | 421334492/ 2057 | 421334493/ 4172 |
| Vibrio cholerae CP1050(23) | 4634 | 17819 | 424605792/ 5210 | missing | 424605794/ 931 | 424605795/ 3071 | 424605796/ 2020 | 424605797/ 4139 |
| Vibrio cholerae H1 | 310730 | 323915 | 457927364/ 5155 | missing | 457927366/ 873 | 457927367/ 3010 | 457927368/ 1962 | 457927369/ 4085 |
| Vibrio cholerae HC-17A1 | 4700 | 17885 | 423730156/ 5136 | missing | 423730158/ 854 | 423730159/ 2991 | 423730160/ 1943 | 423730161/ 4069 |
| Vibrio cholerae HC-17A2 | 4629 | 17814 | 424001206/ 5145 | missing | 424001208/ 863 | 424001209/ 3000 | 424001210/ 1952 | 424001211/ 4077 |
| Vibrio cholerae HC-19A1 | 4649 | 17834 | 423144201/ 5185 | missing | 423144203/ 905 | 423144204/ 3044 | 423144205/ 1994 | 423144206/ 4115 |
| Vibrio cholerae HC-37A1 | 4631 | 17816 | 424005362/ 5166 | missing | 424005364/ 884 | 424005365/ 3023 | 424005366/ 1973 | 424005367/ 4096 |
| Vibrio cholerae HC-38A1 | 4635 | 17820 | 422924882/ 5248 | missing | 422924884/ 972 | 422924885/ 3111 | 422924886/ 2061 | 422924887/ 4176 |

TABLE 10-continued

BREX type 1 systems

| Organism | Genomic Start Point | Genomic End Point | brxA* | brxB* | brxC* | pglX* | pglZ* | brxL* |
|---|---|---|---|---|---|---|---|---|
| Vibrio cholerae HC-39A1 | 4623 | 17808 | 424609627/ 5263 | missing | 424609629/ 988 | 424609630/ 3131 | 424609631/ 2077 | 424609632/ 4189 |
| Vibrio cholerae HC-41A1 | 4650 | 17814 | 424612431/ 5208 | missing | 424612433/ 929 | 424612434/ 3069 | 424612435/ 2018 | 424612436/ 4137 |
| Vibrio cholerae HC-43A1 | 4886 | 18071 | 418348066/ 5259 | missing | 418348068/ 983 | 418348069/ 3125 | 418348070/ 2072 | 418348071/ 4185 |
| Vibrio cholerae HC-46A1 | 7242 | 20406 | 421345611/ 5241 | missing | 421345612/ 964 | 421345553/ 3103 | 421345630/ 2053 | 421345651/ 4168 |
| Vibrio cholerae HC-48A1 | 298 | 12976 | 422901578/ 5222 | missing | 422901580/ 945 | 422901581/ 3085 | 422901582/ 2034 | 422901583/ 4151 |
| Vibrio cholerae HC-49A2 | 7286 | 20471 | 417812640/ 5242 | missing | 417812642/ 965 | 417812643/ 3104 | 417812644/ 2054 | 417812645/ 4169 |
| Vibrio cholerae HC-56A2 | 4633 | 17818 | 424644165/ 5270 | missing | 424644167/ 995 | 424644168/ 3138 | 424644169/ 2084 | 424644170/ 4196 |
| Vibrio cholerae HC-57A2 | 4631 | 17816 | 424651808/ 5230 | missing | 424651810/ 953 | 424651811/ 3092 | 424651812/ 2042 | 424651813/ 4159 |
| Vibrio cholerae HC-61A1 | 6230 | 19394 | 418354574/ 5167 | missing | 418354555/ 885 | 418354534/ 3024 | 418354592/ 1974 | 418354501/ 4097 |
| Vibrio cholerae HC-62A1 | 4643 | 17828 | 423891874/ 5249 | missing | 423891876/ 973 | 423891877/ 3112 | 423891878/ 2062 | 423891879/ 4177 |
| Vibrio cholerae HC-62B1 | 4643 | 17828 | 424023371/ 5207 | missing | 424023373/ 928 | 424023374/ 3068 | 424023375/ 2017 | 424023376/ 4136 |
| Vibrio cholerae HC-64A1 | 4641 | 17826 | 443502702/ 5269 | missing | 443502704/ 994 | 443502705/ 3137 | 443502706/ 2083 | 443502707/ 4195 |
| Vibrio cholerae HC-65A1 | 4643 | 17828 | 443506617/ 5262 | missing | 443506619/ 987 | 443506620/ 3130 | 443506621/ 2076 | 443506622/ 4188 |
| Vibrio cholerae HC-67A1 | 4639 | 17824 | 443510722/ 5127 | missing | 443510724/ 844 | 443510725/ 2981 | 443510726/ 1933 | 443510727/ 4059 |
| Vibrio cholerae HC-69A1 | 4637 | 17822 | 424026175/ 5129 | missing | 424026177/ 846 | 424026178/ 2983 | 424026179/ 1935 | 424026180/ 4061 |
| Vibrio cholerae HC-70A1 | 4639 | 17824 | 422905802/ 5142 | missing | 422905804/ 860 | 422905805/ 2997 | 422905806/ 1949 | 422905807/ 4074 |
| Vibrio cholerae HC-72A2 | 4643 | 17824 | 443522965/ 5212 | missing | 443522967/ 933 | 443522968/ 3073 | 443522969/ 2022 | 443522970/ 4140 |
| Vibrio cholerae HC-77A1 | 4635 | 17820 | 423926648/ 5202 | missing | 423926650/ 923 | 423926651/ 3063 | 423926652/ 2012 | 423926653/ 4131 |
| Vibrio cholerae HC-7A1 | 312355 | 325519 | 443530594/ 5209 | missing | 443530596/ 930 | 443530597/ 3070 | 443530598/ 2019 | 443530599/ 4138 |
| Vibrio cholerae HC-81A1 | 7298 | 20483 | 443537943/ 5130 | missing | 443537945/ 847 | 443537946/ 2984 | 443537947/ 1936 | 443537948/ 4062 |
| Vibrio cholerae HFU-02 | 4640 | 17825 | 422912398/ 5178 | missing | 422912400/ 898 | 422912401/ 3036 | 422932402/ 1987 | 422912403/ 4109 |
| Vibrio cholerae O1 str. 2010EL-1792 | 4571 | 17756 | 458013689/ 5176 | missing | 458013691/ 896 | 458013692/ 3034 | 458013693/ 1985 | 458013694/ 4107 |
| Vibrio cholerae O1 str. 3582-05 | 116442 | 118493 | 458067976/ 5402 | 458067975/ 6206 | 458067974/ 1171 | 458067973/ 3277 | 458067972/ 2249 | 458067971/ 4029 |

TABLE 10-continued

| Organism | Genomic Start Point | Genomic End Point | BREX type 1 systems ||||||
|---|---|---|---|---|---|---|---|---|
| | | | brxA* | brxB* | brxC* | pglX* | pglZ* | brxL* |
| Vibrio cholerae O1 str. EC-0009 | 4667 | 17831 | 472149945/ 5266 | missing | 472149947/ 991 | 472149948/ 3134 | 472149949/ 2080 | 472149950/ 4192 |
| Vibrio cholerae O1 str. EC-0027 | 4644 | 17829 | 472157764/ 5272 | missing | 472157766/ 998 | 472157767/ 3141 | 472157768/ 2087 | 472157769/ 4199 |
| Vibrio cholerae O1 str. EDC-020 | 4648 | 17833 | 472166840/ 5258 | missing | 472166842/ 982 | 472166843/ 3124 | 472166844/ 2071 | 472166845/ 4184 |
| Vibrio cholerae Inaba G4222 | 119978 | 135025 | 449054089/ 5171 | 449054088/ 5763 | 449054087/ 890 | 449054085/ 3029 | 449054084/ 1979 | 449054083/ 4102 |
| Vibrio cholerae O1 str. Nep-21106 | 4644 | 17829 | 472214605/ 5221 | missing | 472214607/ 944 | 472214608/ 3084 | 472214609/ 2033 | 472214610/ 4150 |
| Vibrio cholerae O1 str. Nep-21113 | 4644 | 17829 | 472217724/ 5149 | missing | 472217726/ 867 | 472217727/ 3004 | 472217728/ 1956 | 472217729/ 4080 |
| Vibrio cholerae O1 str. NHCC-004A | 4650 | 17835 | 472199358/ 5123 | missing | 472199360/ 840 | 472199361/ 2978 | 472199362/ 1929 | 472199363/ 4055 |
| Vibrio cholerae O1 str. NHCC-010F | 4648 | 17833 | 472210699/ 5231 | missing | 472210701/ 954 | 472210702/ 3093 | 472210703/ 2043 | 472210704/ 4160 |
| Vibrio cholerae PCS-023 | 4652 | 17837 | 472222753/ 5108 | missing | 472222755/ 825 | 472222756/ 2961 | 472222757/ 1913 | 472222758/ 4042 |
| Vibrio cholerae VC4370 | 4335 | 19471 | 458152045/ 5103 | 458152046/ 5704 | 458152047/ 819 | 458152050/ 2955 | 458152051/ 1907 | 458152052/ 4037 |
| Vibrio harveyi CAIM 1792 | 2186 | 21054 | 472443545/ 5104 | 472443546/ 5705 | 472443547/ 820 | 472443548/ 2956 | 472443552/ 1908 | 472443553/ 4038 |
| Vibrio shilonii AK1 | 42036 | 59655 | 149189598/ 5213 | 149189597/ 5798 | 149189596/ 935 | 149189595/ 3075 | 149189592/ 2024 | 149189591/ 4142 |
| Vibrio tubiashii ATCC 19109 | 78266 | 91498 | 343503397/ 5257 | 343503398/ 5836 | 343503399/ 981 | 343503400/ 3123 | 343503401/ 2070 | 343503402/ 4183 |
| Vibrio cholerae O1 str. 2010EL-1798 | 116441 | 129626 | 458790585/ 5137 | missing | 458790583/ 855 | 458790582/ 2992 | 458790581/ 1944 | 458790580/ 4070 |
| Yersinia ruckeri ATCC 29473 | 13923 | 29006 | 238756189/ 5152 | 238756190/ 5746 | 238756191/ 870 | 238756192/ 3007 | 238756193/ 1959 | 238756194/ 4082 |
| Thioalkalivibrio sp. K90mix | 1195163 | 1212198 | 289208308/ 6225 | 289208309/ 6227 | TK90_1129/ 6229 | 289208312/ 6231 | 289208315/ 6233 | 289208316/ 6235 |

*Numbers are presented by Accession NO./SEQ ID NO.

TABLE 11

BREX type 5 systems

| Organism | Genomic Start Point | Genomic End Point | brxA* | brxB* | BrxC/pglY* | pglX* | pglZ* | brxHII* |
|---|---|---|---|---|---|---|---|---|
| *Halopiger xanaduensis* SH6 uid68105 | 275443 | 305942 | 336252375/ 5065 | 238756192/ 3007 | 336252376/ 736 336252378/ 737 | 336252387/ 2917 | 336252390/ 1835 | 336252392/ 3498 |
| *Halorhabdus utahensis* DSM 12940 uid59189 | 1919731 | 1943689 | missing | 238756192/ 3008 | 257052978/ 738 257052980/ 739 | 257052985/ 2918 | 257052987/ 1836 | 257052989/ 3499 |
| *Halobacterium salinarum* R1 uid61571 | 217533 | 239329 | 169237558/ 5066 | 238756192/ 3009 | 169237555/ 740 169237557/ 741 | 169237551/ 2919 | 169237549/ 1837 | missing |
| *Halorubrum lacusprofundi* ATCC 49239 uid58807 | 421881 | 464896 | 222476096/ 5067 | 238756192/ 3010 | 222476093/ 742 222476095/ 743 | 222476090/ 2920 222476117/ 2921 | 222476089/ 1838 | 222476088/ 3500 |
| *Haloarcula hispanica* ATCC 33960 uid72475 | 401471 | 426563 | 344209887/ 5068 | 238756192/ 3011 | 344209884/ 744 344209886/ 745 | 344209878/ 2922 344209881/ 2923 | 344209879/ 1839 | 344209877/ 3501 |
| halophilic archaeon DL31 uid72619 | 245839 | 265734 | 345007035/ 5069 | 238756192/ 3012 | 345007036/ 746 345007038/ 747 | 345007041/ 2924 | 345007043/ 1840 | 345007044/ 3502 |
| *Natrinema pellirubrum* DSM 15624 uid74437 | 247457 | 267369 | 433593286/ 5070 | 238756192/ 3013 | 433593287/ 748 433593289/ 749 | 433593291/ 2925 433593292/ 2926 | 433593294/ 1841 | 433593295/ 3503 |
| *Natronorubrum tibetense* GA33 | 16416 | 35521 | 448302571/ 5368 | 238756192/ 3014 | 448302568/ 1111 448302570/ 1112 | missing | 448302567/ 2193 | 448302575/ 3527 |
| *Haloarcula argentinensis* DSM 12282 | 133870 | 160866 | 448682081/ 5369 | 238756192/ 3015 | 448682078/ 1113 448682080/ 1114 | 448682072/ 3252 | 448682071/ 2194 | 448682070/ 3528 |
| *Halosimplex carlsbadense* 2-9-1 | 45427 | 67411 | 445667054/ 6167 | 238756192/ 3016 | 448413236/ 1115 448413238/ 1116 | missing | 448413226/ 2195 | 448413225/ 3529 |

*Numbers are presented by Accession NO./SEQ ID NO.

TABLE 12

BREX type 6 systems

| Organism | Genomic Start Point | Genomic End Point | brxE* | brxA* | brxB* |
|---|---|---|---|---|---|
| *Planctomyces limnophilus* DSM 3776 uid48643 | 3979304 | 3995634 | 296123323/ 6037 | 296123322/ 5071 | 296123321/ 5694 |
| *Anaeromyxobacter dehalogenans* 2CP 1 uid58989 | 1284321 | 1301040 | 220916259/ 6038 | 220916260/ 5072 | 220916261/ 5695 |
| *Haliangium ochraceum* DSM 14365 uid41425 | 798493 | 815906 | 262193918/ 6039 | 262193919/ 5073 | 262193920/ 5696 |
| *Haliangium ochraceum* DSM 14365 uid41425 | 1611313 | 1628687 | 262194477/ 6040 | 262194478/ 5074 | 262194479/ 5697 |
| *Rhodopirellula* sp. SWK7 | 94858 | 111243 | 470888969/ 6035 | 470888968/ 5370 | 470888967/ 5702 |
| *Pseudanabaena biceps* PCC 7429 | 10824 | 29281 | 443475075/ 6036 | 443475074/ 5371 | 443475073/ 5943 |

| Organism | BrxC/pglY* | pglX* | pglZ* | brxD* | brxHI* |
|---|---|---|---|---|---|
| *Planctomyces limnophilus* DSM 3776 uid48643 | 296123320/ 750 | 296123319/ 2927 | 296123318/ 1842 | 296123317/ 4441 | 296123316/ 3622 |

TABLE 12-continued

| BREX type 6 systems | | | | | |
|---|---|---|---|---|---|
| Anaeromyxobacter dehalogenans 2CP 1 uid58989 | 220916262/ 751 | 220916263/ 2928 | 220916264/ 1843 | 220916266/ 4442 | 220916267/ 3623 |
| Haliangium ochraceum DSM 14365 uid41425 | 262193921/ 752 | 262193922/ 2929 | 262193923/ 1844 | 262193924/ 4443 | 262193925/ 3624 |
| Haliangium ochraceum DSM 14365 uid41425 | 262194480/ 753 | 262194481/ 2930 | 262194482/ 1845 | 262194483/ 4444 | 262194484/ 3625 |
| Rhodopirellula sp. SWK7 | 470888966/ 1117 | 470888965/ 6186 | 470888964/ 2196 | 470888963/ 4464 | 470888962/ 3626 |
| Pseudanabaena biceps PCC 7429 | 443475072/ 1118 | 443475069/ 6188 | 443475065/ 2197 | 443475063/ 4465 | 443475062/ 3627 |

*Numbers are presented by Accession NO./SEQ ID NO.

TABLE 13

| BREX type 3 systems | | | | | | | | |
|---|---|---|---|---|---|---|---|---|
| Organism | Genomic Start Point | Genomic End Point | brxF* | brxC/pglY* | pglXI* | brxHII* | pglZ* | brxA* |
| Acetohalobium arabaticum DSM 5501 uid51423 | 1471809 | 1481230 | 302392145/ 5919 | 302392144/ 754 | 302392143/ 3343 | missing | 302392142/ 1846 | 302392141/ 5075 |
| Acidothermus cellulolyticus 11B uid58501 | 895934 | 911157 | 117928019/ 5980 | 117928020/ 755 | 117928022/ 3344 | 117928024/ 3504 | 117928025/ 1847 | 117928026/ 5076 |
| Anaerobaculum mobile DSM 13181 uid168323 | 1894751 | 1909131 | 392408180/ 5981 | 392408179/ 756 | 392408178/ 3345 | 392408176/ 3505 | 392408175/ 1848 | 392408174/ 5077 |
| Bacteroides vulgatus ATCC 8482 uid58253 | 4615002 | 4627784 | missing | 150006230/ 757 | 150006231/ 3346 | 150006233/ 3506 | 150006234/ 1849 | 150006235/ 5078 |
| Caldicellulosiruptor kristjanssonii 177R1B uid60393 | 671655 | 683698 | 312792856/ 5982 | 312792857/ 758 | 312792858/ 3347 | Calkr_0625/ 6173 | 312792859/ 1850 | 312792860/ 5079 |
| Chloroflexus aggregans DSM 9485 uid58621 | 1376256 | 1391910 | 219848031/ 5983 | 219848033/ 759 | 219848032/ 3348 219848035/ 3349 | 219848036/ 3507 | 219848037/ 1853 | 219848038/ 5080 |
| Desulfovibrio aespoeensis Aspo 2 uid42613 | 1822100 | 1838149 | 317153363/ 5984 | 317153364/ 760 | 317353366/ 3350 | 317153368/ 3508 | 317153369/ 1852 | 317153370/ 5081 |
| Dichelobacter nodosus VCS1703A uid57643 | 185801 | 200163 | 146328698/ 5985 | 146329396/ 761 | 146329329/ 3351 | 146329165/ 3509 | 146329856/ 1853 | 146328877/ 5082 |
| Methanocaldococcus FS406 22 uid42499 | 892177 | 917259 | 289192374/ 5986 | 289192375/ 762 | 289192376/ 3352 | missing | 289192377/ 1854 | 289192378/ 5083 |
| Methanosalsum zhilinae DSM 4017 uid68249 | 1398867 | 1423843 | 336477236/ 5987 | 336477235/ 764 | 336477234/ 3353 336477237/ 3354 | 336477230/ 3510 | 336477229/ 1855 | 336477228/ 5084 |
| Methylacidiphilum infernorum V4 uid59161 | 315550 | 333912 | 189218342/ 5988 | 189218341/ 765 | 189218335/ 3355 189218340/ 3356 | 189218338/ 3511 | 189218337/ 1856 | 189218336/ 5085 |
| Nitrosococcus oceani ATCC 19707 uid58403 | 53559 | 70307 | 77163602/ 5990 | 77163603/ 767 | 77163606/ 3358 | 77163610/ 3513 | 77163611/ 1858 | 77163612/ 5087 |
| Nitrosococcus watsonii C 113 uid50331 | 43703 | 58760 | 300112781/ 5991 | 300112782/ 768 | 300112784/ 3359 | 300112788/ 3514 | 300112789/ 1859 | 300112790/ 5088 |
| Parvibaculum lavamentivorans DS 1 uid58739 | 1304571 | 1320948 | 154251635/ 5992 | 154251634/ 769 | 154251631/ 3360 | 154251630/ 3515 | 154251629/ 1860 | 154251628/ 5089 |
| Parvibaculum lavamentivorans DS 1 uid58739 | 3796620 | 3812997 | 154253985/ 5993 | 154253986/ 770 | 154253989/ 3361 | 154253990/ 3516 | 154253991/ 1861 | 154253992/ 5090 |
| Planctomyces brasiliensis DSM 5305 uid60583 | 1319340 | 1355964 | 325107713/ 5994 | 325107712/ 771 | 325107710/ 3362 | 325107709/ 3517 | 325107708/ 1862 | 325107707/ 5091 |
| Syntrophothermus lipocalidus DSM 12680 uid49527 | 1307414 | 1328282 | 297617453/ 5995 | 297617452/ 772 | 297617451/ 3363 | missing | 297617450/ 1863 | 297617449/ 5092 |
| Tepidanaerobacter acetatoxydans Re1 uid184827 | 1934820 | 1944222 | 438003074/ 5996 | 438003073/ 774 | 438003072/ 3364 | missing | 438003071/ 1864 | 438003070/ 5093 |
| Tepidanaerobacter Re1 uid66873 | 1933717 | 1943118 | 332799810/ 5997 | 332799809/ 775 | 332799808/ 3365 | missing | 332799807/ 1865 | 332799806/ 5094 |
| Thermanaerovibrio acidaminovorans DSM 6589 uid41925 | 1551823 | 1568220 | 269793100/ 5998 | 269793099/ 776 | 269793097/ 3366 | 269793095/ 3518 | 269793094/ 1866 | 269793093/ 5095 |

TABLE 13-continued

BREX type 3 systems

| Organism | Genomic Start Point | Genomic End Point | brxF* | brxC/pglY* | pglXI* | brxHII* | pglZ* | brxA* |
|---|---|---|---|---|---|---|---|---|
| Thermoanaerobacter brockii finnii Ako 1 uid55639 | 974096 | 986151 | 320115754/ 5999 | 320115755/ 777 | 320115756/ 3367 | 320115757/ 3519 | 320115758/ 1867 | 320115759/ 5096 |
| Thermoanaerobacter italicus Ab9 uid46241 | 1369765 | 1379419 | 289578546/ 6000 | 289578545/ 778 | 289578544/ 3368 | missing | 289578542/ 1868 | 289578541/ 5097 |
| Thermoanaerobacter pseudethanolicus ATCC 33223 uid58339 | 981903 | 993958 | 167037338/ 6001 | 167037339/ 779 | 167037340/ 3369 | 167037341/ 3520 | 167037342/ 1869 | 167037343/ 5098 |
| Thermoanaerobacterium saccharolyticum JW SL YS485 uid167781 | 2325486 | 2337569 | 390935378/ 6002 | 390935377/ 780 | 390935376/ 3370 | 390935375/ 3521 | 390935374/ 1870 | 390935373/ 5099 |
| Thermoanaerobacterium thermosaccharolyticum M0795 uid184821 | 1846040 | 1858147 | 433655487/ 6003 | 433655486/ 781 | 433655485/ 3371 | 433655484/ 3522 | 433655483/ 1871 | 433655482/ 5100 |
| Thermoanaerobacterium xylanolyticum LX 11 uid63163 | 1036830 | 1048931 | 333896805/ 6004 | 333896806/ 782 | 333896807/ 3372 | 333896808/ 3523 | 333896809/ 1872 | 333896810/ 5101 |
| Pelotomaculum thermopropionicum SI uid58877 | 698030 | 719373 | | 147677041/ 616 | 147677050/ 3403 | #N/A | 147677052/ 1177 | |
| planctomycete KSU-1 | 302255 | 318802 | 386811047/ 6005 | 386811046/ 1119 | 386811042/ 3373 | 386811038/ 3530 | 386811037/ 2198 | 386811036/ 5372 |
| Bacillus cereus W | 64027 | 76920 | 196035241/ 6006 | 196035162/ 1120 | 196035235/ 3374 | 196035256/ 3531 | 196035132/ 2199 | 196035248/ 5373 |
| Clostridium thermocellum YS | 67367 | 77609 | missing | 419725844/ 1121 | 419725843/ 3375 | 419725842/ 3532 | 419725841/ 2200 | 419725839/ 5374 419725840/ 5375 |
| Lachnospiraceae bacteriu | 835791 | 847349 | 336426893/ 6007 | 336426892/ 1122 | 336426890/ 3376 336426891/ 3377 | 336426889/ 3533 | 336426888/ 2201 | 336426887/ 5376 |
| Enterococcus faecium 1,231,501 | | 115722 | 257885933/ 6008 | 257885934/ 1123 | 257885935/ 3378 | missing | 257885936/ 2202 | 257885937/ 6170 |
| Caloramator australicus RC3]Length = 15 | 17570 | 34190 | 397905665/ 6009 | 397905666/ 1124 | 397905667/ 3379 397905668/ 3380 397905669/ 3381 397905678/ 3382 | 397905670/ 3534 | 397905671/ 2203 | 397905672/ 5377 |
| Pseudoalteromonas marina mano4 | 51753 | 65055 | 392538886/ 6010 | 392538885/ 1125 | 392538884/ 3383 | 392538883/ 3535 | 392538882/ 2204 | 392538880/ 5378 392538881/ 5379 |
| Desulfotomaculum nigrificans DSM 574 | 104421 | 114874 | 323701233/ 6011 | 323701234/ 1126 | 323701235/ 3384 | missing | 323701238/ 2205 | 323701239/ 5380 |
| Dethiosulfovibrio peptidovorans DSM 11002 | 2471763 | 2489488 | 288575103/ 6012 | 288575102/ 1127 | 288575100/ 3385 | DpepDRAFT_ 2372/6176 | 288575095/ 2206 | 288575094/ 5381 |
| Kingella denitrificans ATCC 33394 | 998416 | 1009424 | 325266722/ 6013 | 325266723/ 1128 | 325266724/ 3386 | 325266725/ 6177 | 325266726/ 2207 | 325266727/ 5382 |
| Alcanivorax hongdengensis A-11-3 | 66342 | 85539 | 408373946/ 6014 | 408373945/ 1129 | 408373941/ 3387 | 408373939/ 3536 | 408373938/ 2208 | 408373937/ 5383 |
| Bacillus cereus BAG2X1-1 | 4134446 | 4144054 | 423398560/ 6015 | 423398559/ 1130 | 423398558/ 3388 | 401647033/ 6178 | 423398557/ 2209 | 423398556/ 5384 |
| Nitrosococcus oceani AFC27 | 570876 | 587579 | 254435536/ 6016 | 254435628/ 1131 | 254435024/ 3389 | missing | 254436183/ 2210 | 254435793/ 5385 |
| Methyloversatilis universalis FAM5 | 13404 | 25532 | missing | 334130736/ 1132 | 334130735/ 3390 | 334130734/ 3537 | 334130733/ 2211 | 334130732/ 5386 |
| Thermoplasmatales archaeon SCGC AB-539-N05 | 1730 | 14243 | 472439489/ 6017 | 472439490/ 1133 | 472439492/ 3391 | missing | 472439494/ 2212 | 472439495/ 5387 |
| Pseudomonas sp. GM55 | 71736 | 85194 | 398889060/ 6018 | 398889059/ 1134 | 398889058/ 3392 | PMI31_00817 | 398889056/ 2213 | 398889055/ 5388 |
| Bacillus cereus 03BB108 | 37106 | 46755 | 196044400/ 6019 | 196044278/ 1135 | 196044173/ 3393 | 168166142 | 196044220/ 2214 | 196044133/ 5389 |
| Treponema primitia ZAS-1 | 9000 | 34287 | 374812240/ 6020 | 374812241/ 1136 | 374812242/ 3394 | 374812236/ 3538 | 374812248/ 2215 | 374812249/ 5415 |
| Bacillus methanolicus MGA3 | 39939 | 49733 | 415887046/ 6021 | 415887047/ 1137 | 415887048/ 3395 | MGA3_16723/ 6180 | 415887049/ 2216 | 415887050/ 5390 |

TABLE 13-continued

BREX type 3 systems

| Organism | Genomic Start Point | Genomic End Point | brxF* | brxC/pglY* | pglXI* | brxHII* | pglZ* | brxA* |
|---|---|---|---|---|---|---|---|---|
| Vibrio scophthalmi LMG 19158 | 609 | 13898 | 343509541/ 6022 | 343509540/ 1138 | 343509539/ 3396 | 343509538/ 3539 | 343509537/ 2217 | 343509534/ 5391 343509535/ 5392 343509536/ 5393 |
| Thiorhodovibrio sp. 970 | 32332 | 48989 | 381156867/ 6023 | 381156866/ 1139 | 381156864/ 3397 | Thi970DRAFT_ 0448/6183 | 381156859/ 2218 | 381156858/ 5394 |
| Ectothiorhodospir | 1 | 13805 | 374623711/ 6024 | 374623710/ 1140 | 374623709/ 3398 | 374623707/ 3540 | 374623706/ 2219 | missing |
| Clostridium papyrosolvens DSM 2782 | 27432 | 39463 | 326204497/ 6025 | 326204498/ 1141 | 326204499/ 3399 | 326204500/ 3541 | 326204501/ 2220 | 326204502/ 5395 |
| Thermoanaerobacter ethanolicus JW 200 | 35382 | 49116 | 326389944/ 6026 | 326389943/ 1142 | 326389941/ 3400 | 326389940/ 3542 | 326389939/ 2221 | 326389938/ 5396 |
| Thermoanaerobacter ethanolicus CCSD1 | 8992 | 18633 | 256752453/ 6027 | 256752454/ 1143 256752455/ 1144 | 256752456/ 3401 | missing | 256752458/ 2222 | 256752459/ 5397 |
| Nitrococcus mobilis Nb-231 | 2181486 | 2199782 | 88811251/ 6028 | 88811250/ 1145 | 88811247/ 3402 | NB231_10583/ 6184 | 88811242/ 2223 | 88811241/ 5398 |

*Numbers are presented by Accession NO./SEQ ID NO.

TABLE 14

BREX type 2 systems

| Organism | Genomic Start Point | Genomic End Point | pglW* | pglX* | pglY* | pglZ* | brxD* | brxHI* |
|---|---|---|---|---|---|---|---|---|
| Burkholderia thailandensis E264 uid58081 | 131918 | 145741 | 83720701/ 6091 | 83719870/ 2931 | 83719623/ 783 | 83719262/ 1873 | missing | missing |
| Candidatus Accumulibacter phosphalis clade IIA UW 1 uid59207 | 3869550 | 3890263 | 257094932/ 6092 | 257094931/ 2932 | 257094926/ 784 | 257094925/ 1874 | 257094924/ 4445 | 257094923/ 3596 |
| Corallococcus coralloides DSM 2259 uid157997 | 6591319 | 6611764 | 383457207/ 6093 | 383457206/ 2933 | 383457202/ 785 383457204/ 786 | 383457203/ 1875 | missing | 383457201/ 3597 |
| Corynebacterium variabile DSM 44702 uid62003 | 1913373 | 1933608 | 340794635/ 6094 | 340794636/ 2934 | 340794637/ 787 | 340794638/ 1876 | 340794639/ 4446 | 340794640/ 3598 |
| Frankia CcI3 uid58397 | 3489708 | 3507585 | 86741639/ 6095 | 86741640/ 2935 | 86741641/ 788 | 86741642/ 1877 | 86741643/ 4447 | 86741644/ 3599 |
| Frankia EuI1c uid42615 | 6951904 | 6971263 | 312199458/ 6096 | 312199459/ 2936 | 312199460/ 789 | 312199461/ 1878 | 312199462/ 4448 | 312199463/ 3600 |
| Haliangium ochraceum DSM 14365 uid41425 | 1565170 | 1582937 | 262194452/ 6097 | 262194453/ 2937 | 262194454/ 790 | 262194455/ 1879 | 262194456/ 791 | 262194457/ 3601 |
| Microlunatus phosphovorus NM 1 uid68055 | 3075705 | 3093432 | 336118511/ 6098 | 336118510/ 2938 | 336118509/ 792 | 336118508/ 1880 | 336118507/ 4449 | 336118506/ 3602 |
| Micromonospora aurantiaca ATCC 27029 uid42501 | 1329830 | 1350410 | 302865792/ 6099 | 302865793/ 2939 | 302865796/ 793 | 302865797/ 1881 | 302865798/ 4450 | 302865799/ 3603 |
| Mycobacterium gilvum PYR GCK uid59421 | 3386977 | 3404461 | 145223791/ 6100 | 145223790/ 2940 | 145223789/ 794 | 145223788/ 1882 | 145223787/ 4451 | 145223786/ 3604 |
| Nocardia cyriacigeorgica GUH 2 uid89395 | 1974963 | 1993641 | 379708002/ 6101 | 379708001/ 2941 | 379708000/ 795 | 379707999/ 1883 | 379707998/ 4452 | 379707997/ 3605 |
| Polaromonas naphthalenivorans CJ2 uid58273 | 170793 | 210985 | 121582867/ 6102 | 121582865/ 2942 | 121582862/ 796 | 121582861/ 1884 | 121582860/ 4453 | 121582859/ 3606 |
| | | | | 121582883/ 2943 | | | | |
| Saccharomonospora viridis DSM 43017 uid59055 | 508003 | 530821 | 257054581/ 6103 | 257054590/ 2944 | 257054591/ 797 | 257054592/ 1885 | 257054593/ 4454 | 257054594/ 3607 |
| Saccharopolyspora erythraea NRRL 2338 uid62947 | 5714083 | 5731753 | 134101641/ 6104 | 134101640/ 2945 | 134101639/ 798 | 134101638/ 1886 | 134101637/ 4455 | 134101636/ 3608 |
| Saccharothrix espanaensis DSM 44229 uid184826 | 1882970 | 1907934 | 433603667/ 6105 | 433603658/ 2946 | 433603653/ 799 | 433603652/ 1887 | 433603651/ 4456 | 433603650/ 3609 |
| Singulisphaera acidiphila DSM 18658 uid81777 | 2421532 | 2440518 | 430742885/ 6106 | 430742884/ 2947 | 430742881/ 800 | 430742880/ 1888 | 430742879/ 4457 | 430742878/ 3610 |

TABLE 14-continued

| | | | BREX type 2 systems | | | | | |
|---|---|---|---|---|---|---|---|---|
| Organism | Genomic Start Point | Genomic End Point | pglW* | pglX* | pglY* | pglZ* | brxD* | brxHI* |
| *Sorangium cellulosum* So ce 56 uid61629 | 10676864 | 10731426 | 162455957/ 6107 162455970/ 6108 162455983/ 6109 | 162455958/ 2948 | 162455964/ 801 | 162455967/ 1889 | 162455968/ 4458 | 162455969/ 3611 |
| *Streptomyces coelicolor* A3 2 uid57801 | 7348537 | 7376403 | 21224924/ 6110 | 32141309/ 2949 | 21224932/ 802 | 21224933/ 1890 | 21224936/ 4459 | 21224937/ 3612 |
| *Streptomyces griseus* NBRC 13350 uid58983 | 1877109 | 1900853 | 182435393/ 6111 | 182435394/ 2950 | 182435399/ 803 | 182435400/ 1891 | 182435403/ 4460 | 182435404/ 3613 |
| *Thermobifida fusca* YX uid57703 | 810381 | 853382 | 72161105/ 6112 | 72161128/ 2951 | 72161113/ 804 | 72161114/ 1892 | 72161115/ 4461 | 72161116/ 3614 |
| *Thermobispora bispora* DSM 43833 uid48999 | 1764882 | 1779583 | 296269520/ 6113 | 296269521/ 2952 | 296269522/ 805 | 296269523/ 1893 | missing | missing |
| *Hahella chejuensis* KCTC 2396 uid58483 | 3587257 | 3606877 | 83646207/ 6114 | 83646204/ 2953 | 83646203/ 806 | 83646202/ 1894 | 83646201/ 4462 | 83646200/ 3615 |
| *Saccharomonospora glauca* K62 | 539845 | 562776 | 384564483/ 6115 | 384564490/ 3253 | 384564491/ 1146 | 384564492/ 2224 | 384564493/ 4466 | 384564494/ 3616 |
| *Rhodococcus triatomae* BKS 15-14 | 58688 | 79518 | 453074717/ 6116 | 453074718/ 3254 | 453074722/ 1147 | 453074723/ 2225 | 453074724/ 4467 | 453074725/ 3617 |
| *Saccharomonospora cyanea* NA-134 | 604367 | 625835 | 375098936/ 6117 | 375098940/ 3255 | 375098941/ 1148 | 375098942/ 2226 | 375098943/ 4468 | 375098944/ 3618 |
| *Gordonia polyisoprenivorans* NBRC 16320 | 51878 | 69760 | 359765504/ 6118 | 359765505/ 3256 | 359765506/ 1149 | 359765507/ 2227 | 359765508/ 4469 | 359765509/ 3619 |
| *Amycolatopsis azurea* DSM 43854 | 30190 | 53418 | 451335443/ 6119 | 451335436/ 3257 | 451335435/ 1150 | 451335434/ 2228 | 451335432/ 4470 | 451335431/ 3620 |
| *Marinobacter* sp. ELB17 | 49994 | 72968 | 126666550/ 6120 | 126666547/ 3258 | 126666537/ 1151 | 126666536/ 2229 | 126666535/ 4471 | 126666534/ 3621 |
| *Saccharopolyspora erythraea* NRRL 2338 | 144893 | 160200 | 291003191/ 6121 | 291003192/ 3259 | 291003193/ 1152 | 291003194/ 2230 | 291003195/ 4472 | missing |
| *Streptomyces turgidiscabies* Car8 | 9173 | 41654 | 440700787/ 6122 | 440700766/ 3260 | 440700790/ 1153 | 440700796/ 2231 | 440700764/ 4473 | 440700770/ 3628 |
| *Gemma taobscuriglobus* UQM 2246 | 27609 | 48046 | 168697904/ 6123 | 168697902/ 3261 | 168697899/ 1154 | 168697898/ 2232 | 168697897/ 4474 | 168697896/ 3629 |
| *Rhodococcus ruber* BKS 20-38 | 6599 | 29593 | 458780602/ 6124 | 458780601/ 3262 | 458780598/ 1155 | 458780597/ 2233 | 458780596/ 4475 | 458780593/ 3630 |
| *Mycobacterium xenopi* RIVM700367 | 216677 | 234966 | 383824736/ 6125 | 383824739/ 3263 | 383824740/ 1156 | 383824741/ 2234 | 383824742/ 4476 | 383824743/ 3631 |
| *Micromonospora* sp. ATCC 39149 | 4955630 | 4982819 | 238063210/ 6126 | 238063211/ 3264 | 238063221/ 1157 | 238063222/ 2235 | 238063223/ 4477 | 238063224/ 3632 |
| *Saccharomonospora xinjiangensis* XJ-54 | 1696320 | 1718030 | 383828993/ 6127 | 383828987/ 3265 | 383828986/ 1158 | 383828985/ 2236 | 383828984/ 4478 | 383828983/ 3633 |
| *Bradyrhizobium* sp. ORS 375 | 19316 | 37325 | 365878962/ 6128 | 365878961/ 3266 | 365878960/ 1159 | 365878959/ 2237 | 365878958/ 4479 | 365878957/ 3634 |
| *Burkholderia thailandensis* E264 | 3406043 | 3419866 | 257140682/ 6129 | 257140680/ 3267 | 257140679/ 1160 | 257140678/ 2238 | missing | missing |
| *Planctomyces maris* DSM 8797 | 100676 | 119360 | 149176313/ 6130 | 149176311/ 3268 | 149176310/ 1161 | 149176309/ 2239 | 149176308/ 4480 | 149176307/ 3635 |
| *Streptomyces gancidicus* BKS 13-15 | 67474 | 97086 | 458859650/ 6131 | 458859651/ 3269 | 458859660/ 1162 | 458859661/ 2240 | 458859664/ 4481 | 458859665/ 3636 |
| *Gordonia amicalis* NBRC 100051 = JCM 11271 | 3958 | 21621 | 441515888/ 6132 | 441515889/ 3270 | 441515890/ 1163 | 441515891/ 2241 | 441515892/ 4482 | 441515893/ 3637 |
| *Mycobacterium intracellulare* ATCC 13950 | 14963 | 30468 | 254821509/ 6133 | 254821510/ 3271 | 254821511/ 1164 | 254821513/ 2242 | 254821514/ 4483 | missing |
| *Phaeospirillum molischianum* DSM 120 | 9727 | 29750 | 381168760/ 6134 | 381168763/ 3272 | 381168766/ 1165 | 381168767/ 2243 | 381168768/ 4484 | 381168769/ 3638 |
| *Nitrococcus mobilis* Nb-231 | 3284658 | 3304962 | 88810583/ 6135 88810585/ 6136 | 88810586/ 3273 | 88810589/ 1166 | 88810590/ 2244 | 88810591/ 4485 | 88810592/ 3639 |
| *Frankia* sp. EUN1f | 4751 | 24481 | 288920048/ 6137 | 288920049/ 3274 | 288920050/ 1167 | 288920051/ 2245 | 288920052/ 4486 | 288920053/ 3640 |
| *Pseudomonas stutzeri* NF13 | 77221 | 95110 | 452746641/ 6138 | missing | 452746643/ 1168 | 452746644/ 2246 | 452746645/ 4487 | 452746646/ 3641 |
| *Dietzia cinnamea* P4 | 1 | 10875 | missing | 319947886/ 3275 | 319947887/ 1169 | 319947888/ 2247 | 319947889/ 4488 | 319947890/ 3642 |

*Numbers are presented by Accession NO./SEQ ID NO.

TABLE 15

BREX type 4 systems

| Organism | Genomic Start Point | Genomic End Point | brxP* | brxC/pglY* | pglZ* | brxL* |
|---|---|---|---|---|---|---|
| *Aciduliprofundum* MAR08 339 uid184407 | 1211535 | 1229434 | 432329235/ 3428 | 432329234/ 807 | 432329233/ 1895 | 432329232/ 4403 |
| *Anaerobaculum mobile* DSM 13181 uid168323 | 1574689 | 1585597 | 392407896/ 3429 392407897/ 3430 | 392407895/ 808 | 392407894/ 1896 | 392407893/ 4404 |
| *Candidatus Desulforudis audaxviator* MP104C uid59067 | 837185 | 861804 | 169830967/ 3431 | 169830968/ 809 | 169830970/ 1897 | 169830971/ 4405 |
| *Coprothermobacter proteolyticus* DSM 5265 uid59253 | 1373786 | 1384972 | 206895424/ 3432 206895920/ 3433 | 206896068/ 810 | 206895399/ 1898 | 206895834/ 4406 |
| *Cyanobacterium stanieri* PCC 7202 uid183337 | 2847921 | 2863377 | 428774403/ 3434 | 428774405/ 812 | 428774399/ 1899 | 428774398/ 4407 |
| *Denitrovibrio acetiphilus* DSM 12809 uid46657 | 583467 | 593592 | 291286509/ 3435 | 291286510/ 813 | 291286511/ 1900 | 291286512/ 4408 |
| *Desulfitobacterium dichloroeliminans* LMG P 21439 uid82555 | 793871 | 804051 | 431792781/ 3436 | 431792782/ 814 | 431792783/ 1901 | 431792784/ 4409 |
| *Geobacter* M21 uid59037 | 937933 | 948073 | 253699433/ 3437 | 253699434/ 815 | 253699435/ 1902 | 253699436/ 4410 |
| *Prevotella denticola* F0289 uid65091 | 414128 | 424374 | 327312660/ 3438 | 327312662/ 816 | 327312663/ 1903 | 327312664/ 4411 |
| *Thermotoga petrophila* RKU 1 uid58655 | 1747153 | 1782820 | 148270868/ 3439 | 148270869/ 817 | 148270870/ 1904 | 148270871/ 4412 |
| *Thermomicrobium roseum* DSM 5159 uid59341 | 91162 | 104624 | A truncated brxP was missed by ORF finder tool. | 221635509/ 1714 | 221635513/ 1714 | 221635514/ 4299 |

*Numbers are presented by Accession NO./SEQ ID NO.

TABLE 16

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 1 | *Pseudanabaena biceps* PCC 7429 | x | | x | | | | Genome contains two BREX systems: #1 and #6 |
| 2 | *Moorella thermoacetica* ATCC 39073 uid58051 | x | | | | | | |
| 3 | *Tepidanaerobacter acetatoxydans* Re1 uid184827 | x | | | x | | | Genome contains two BREX systems: #1 and #3 |
| 4 | *Tepidanaerobacter* Re1 uid66873 | x | | | x | | | Genome contains two BREX systems: #1 and #3 |
| 5 | *Thiorhodovibrio* sp. 970 | x | | | x | | | Genome contains two BREX systems: #1 and #3 |
| 6 | *Marinobacter* sp. ELB17 | x | | | | x | | Genome contains two BREX systems: #1 and #2 |
| 7 | *Microlunatus phosphovorus* NM 1 uid68055 | x | | | | x | | Genome contains two BREX systems: #1 and #2 |
| 8 | *Acetivibrio cellulolyticus* CD2 | x | | | | | | |
| 9 | *Acidiphilium multivorum* AIU301 uid63345 | x | | | | | | |
| 10 | *Acidithiobacillus ferrivorans* SS3 uid67387 | x | | | | | | |
| 11 | *Acidovorax* sp. NO-1 | x | | | | | | |
| 12 | *Acinetobacter baumannii* AB5256 | x | | | | | | |
| 13 | *Acinetobacter baumannii* AYE uid61637 | x | | | | | | |
| 14 | *Acinetobacter baumannii* Naval-18 | x | | | | | | |
| 15 | *Acinetobacter baumannii* OIFC098 | x | | | | | | |
| 16 | *Acinetobacter baumannii* WC-136 | x | | | | | | |
| 17 | *Acinetobacter johnsonii* SH046 | x | | | | | | |
| 18 | *Acinetobacter junii* SH205 | x | | | | | | |
| 19 | *Acinetobacter lwoffii* SH145 | x | | | | | | |
| 20 | *Acinetobacter radioresistens* DSM 6976 = NBRC 102413 | x | | | | | | |
| 21 | *Acinetobacter* sp. P8-3-8 | x | | | | | | |
| 22 | *Acinetobacter* sp. SH024 | x | | | | | | |
| 23 | *Actinomyces neuii* BVS029A5 | x | | | | | | |

TABLE 16-continued

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 24 | *Actinomyces* sp. ICM47 | x | | | | | | |
| 25 | *Actinomyces* sp. oral taxon 178 str | x | | | | | | |
| 26 | *Alcanivorax pacificus* W11-5 | x | | | | | | |
| 27 | *Alcanivorax* sp. DG881 | x | | | | | | |
| 28 | *Alteromonas macleodii* Black Sea 11 uid176365 | x | | | | | | |
| 29 | *Anaeromyxobacter dehalogenans* 2CP C uid58135 | x | | | | | | |
| 30 | *Aromatoleum aromaticum* EbN1 uid58231 | x | | | | | | |
| 31 | *Arthrobacter nitroguajacolicus* Rue61a uid174511 | x | | | | | | |
| 32 | *Aurantimonas manganoxydans* SI85-9A1 | x | | | | | | |
| 33 | *Azospirillum lipoferum* 4B uid82343 | x | | | | | | |
| 34 | *Bacillus cereus* BAG6X1-2 | x | | | | | | |
| 35 | *Bacillus cereus* H3081.97 | x | | | | | | |
| 36 | *Bacillus cereus* HuB2-9 | x | | | | | | |
| 37 | *Bacteroides coprophilus* DSM 18228 | x | | | | | | |
| 38 | *Bacteroides ovatus* CL02T12C04 | x | | | | | | |
| 39 | *Bacteroides ovatus* SD CC 2a | x | | | | | | |
| 40 | *Bacteroides ovatus* SD CMC 3f | x | | | | | | |
| 41 | *Bacteroides* sp. 1_1_14 | x | | | | | | |
| 42 | *Bacteroides* sp. 2_1_7 | x | | | | | | |
| 43 | *Bacteroides* sp. 3_1_33FAA | x | | | | | | |
| 44 | *Bacteroides* sp. D1 | x | | | | | | |
| 45 | *Bacteroides* sp. D2 | x | | | | | | |
| 46 | *Bacteroides* sp. 2_1_22 | x | | | | | | |
| 47 | *Bacteroides xylanisolvens* SD CC 1b | x | | | | | | |
| 48 | *Bifidobacterium angulatum* DSM 20098 | x | | | | | | |
| 49 | *Bifidobacterium animalis* ATCC 25527 uid162513 | x | | | | | | |
| 50 | *Bifidobacterium bifidum* IPL | x | | | | | | |
| 51 | *Bifidobacterium bifidum* NCIMB 41171 | x | | | | | | |
| 52 | *Bordetella parapertussis* Bpp5 uid177516 | x | | | | | | |
| 53 | *Brachybacterium paraconglomeratum* LC44 | x | | | | | | |
| 54 | *Brevibacterium mcbrellneri* ATCC 49030 | x | | | | | | |
| 55 | *Burkholderia* CCGE1001 uid42975 | x | | | | | | |
| 56 | *Burkholderia gladioli* BSR3 uid66301 | x | | | | | | |
| 57 | *Burkholderia vietnamiensis* G4 uid58075 | x | | | | | | |
| 58 | *Calditerrivibrio nitroreducens* DSM 19672 uid60821 | x | | | | | | |
| 59 | *Carboxydothermus hydrogenoformans* Z 2901 uid57821 | x | | | | | | |
| 60 | *Cellvibrio* sp. BR | x | | | | | | |
| 61 | *Chlorobium phaeobacteroides* BS1 uid58131 | x | | | | | | |
| 62 | *Clostridium butyricum* E4 str. BoNT E BL5262 | x | | | | | | |
| 63 | *Clostridium ljungdahlii* DSM 13528 uid50583 | x | | | | | | |
| 64 | *Clostridium perfringens* C str. JGS1495 | x | | | | | | |
| 65 | *Clostridium perfringens* D str. JGS1721 | x | | | | | | |
| 66 | *Clostridium sticklandii* DSM 519 uid59585 | x | | | | | | |
| 67 | *Clostridium* SY8519 uid68705 | x | | | | | | |
| 68 | *Collinsella aerofaciens* ATCC 25986 | x | | | | | | |
| 69 | *Collinsella intestinalis* DSM 13280 | x | | | | | | |
| 70 | *Collinsella stercoris* DSM 13279 | x | | | | | | |
| 71 | *Coprobacillus* sp. 3_3_56FAA | x | | | | | | |
| 72 | *Coprobacillus* sp. 8_2_54BFAA | x | | | | | | |
| 73 | *Cupriavidus necator* N 1 uid68689 | x | | | | | | |
| 74 | *Cyanothece* PCC 8802 uid59143 | x | | | | | | |
| 75 | *Cylindrospermopsis raciborskii* CS-505 | x | | | | | | |
| 76 | *Dehalococcoides* VS uid42393 | x | | | | | | |
| 77 | *Dehalogenimonas lykanthroporepellens* BL DC 9 uid48131 | x | | | | | | |
| 78 | delta proteobacterium NaphS2 | x | | | | | | |
| 79 | *Desulfitobacterium hafniense* Y51 uid58605 | x | | | | | | |
| 80 | *Desulfobacula toluolica* Tol2 uid175777 | x | | | | | | |
| 81 | *Desulfomicrobium baculatum* DSM 4028 uid59217 | x | | | | | | |
| 82 | *Desulfonatronospira thiodismutans* ASO3-1 | x | | | | | | |
| 83 | *Desulfosporosinus meridiei* DSM 13257 uid75097 | x | | | | | | |
| 84 | *Desulfotomaculum gibsoniae* DS | x | | | | | | |
| 85 | *Desulfovibrio magneticus* RS 1 uid59309 | x | | | | | | |

TABLE 16-continued

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 86 | *Desulfovibrio vulgaris* Hildenborough uid57645 | x | | | | | | |
| 87 | *Desulfovibrio vulgaris* RCH1 uid161961 | x | | | | | | |
| 88 | *Desulfurivibrio alkaliphilus* AHT2 uid49487 | x | | | | | | |
| 89 | *Enterobacter cloacae* ENHKU01 uid172463 | x | | | | | | |
| 90 | *Enterobacter hormaechei* ATCC 49162 | x | | | | | | |
| 91 | *Enterobacter* sp. SST3 | x | | | | | | |
| 92 | *Enterococcus faecalis* TX0109 | x | | | | | | |
| 93 | *Enterococcus faecalis* TX1302 | x | | | | | | |
| 94 | *Enterococcus faecium* 509 | x | | | | | | |
| 95 | *Enterococcus faecium* 511 | x | | | | | | |
| 96 | *Enterococcus faecium* 514 | x | | | | | | |
| 97 | *Enterococcus faecium* C1904 | x | | | | | | |
| 98 | *Enterococcus faecium* C497 | x | | | | | | |
| 99 | *Enterococcus faecium* E0679 | x | | | | | | |
| 100 | *Enterococcus faecium* E1731 | x | | | | | | |
| 101 | *Enterococcus faecium* E1904 | x | | | | | | |
| 102 | *Enterococcus faecium* E2883 | x | | | | | | |
| 103 | *Enterococcus faecium* ERV99 | x | | | | | | |
| 104 | *Enterococcus faecium* P1123 | x | | | | | | |
| 105 | *Enterococcus faecium* P1137 | x | | | | | | |
| 106 | *Enterococcus faecium* P1139 | x | | | | | | |
| 107 | *Enterococcus faecium* TX0133A | x | | | | | | |
| 108 | *Enterococcus faecium* TX0133a01 | x | | | | | | |
| 109 | *Enterococcus faecium* TX0133a04 | x | | | | | | |
| 110 | *Enterococcus faecium* TX0133B | x | | | | | | |
| 111 | *Enterococcus faecium* TX0133C | x | | | | | | |
| 112 | *Erwinia* Ejp617 uid159955 | x | | | | | | |
| 113 | *Erwinia pyrifoliae* DSM 12163 uid159693 | x | | | | | | |
| 114 | *Erwinia pyrifoliae* Ep1 96 uid40659 | x | | | | | | |
| 115 | *Erythrobacter litoralis* HTCC2594 uid58299 | x | | | | | | |
| 116 | *Escherichia coli* clone D i14 uid162049 | x | | | | | | |
| 117 | *Escherichia coli* clone D i2 uid162047 | x | | | | | | |
| 118 | *Escherichia coli* 2534-86 | x | | | | | | |
| 119 | *Escherichia coli* 3.3884 | x | | | | | | |
| 120 | *Escherichia coli* 4.0522 | x | | | | | | |
| 121 | *Escherichia coli* 96.154 | x | | | | | | |
| 122 | *Escherichia coli* B41 | x | | | | | | |
| 123 | *Escherichia coli* B799 | x | | | | | | |
| 124 | *Escherichia coli* DEC10E | x | | | | | | |
| 125 | *Escherichia coli* DEC10F | x | | | | | | |
| 126 | *Escherichia coli* DEC13A | x | | | | | | |
| 127 | *Escherichia coli* DEC13B | x | | | | | | |
| 128 | *Escherichia coli* DEC13C | x | | | | | | |
| 129 | *Escherichia coli* DEC13D | x | | | | | | |
| 130 | *Escherichia coli* DEC13E | x | | | | | | |
| 131 | *Escherichia coli* DEC14B | x | | | | | | |
| 132 | *Escherichia coli* DEC14C | x | | | | | | |
| 133 | *Escherichia coli* DEC14D | x | | | | | | |
| 134 | *Escherichia coli* DEC7B | x | | | | | | |
| 135 | *Escherichia coli* DEC8A | x | | | | | | |
| 136 | *Escherichia coli* DEC8B | x | | | | | | |
| 137 | *Escherichia coli* DEC9A | x | | | | | | |
| 138 | *Escherichia coli* DEC9B | x | | | | | | |
| 139 | *Escherichia coli* DEC9C | x | | | | | | |
| 140 | *Escherichia coli* DEC9D | x | | | | | | |
| 141 | *Escherichia coli* DEC9E | x | | | | | | |
| 142 | *Escherichia coli* HS uid58393 | x | | | | | | |
| 143 | *Escherichia coli* JB1-95 | x | | | | | | |
| 144 | *Escherichia coli* KD2 | x | | | | | | |
| 145 | *Escherichia coli* KTE12 | x | | | | | | |
| 146 | *Escherichia coli* KTE139 | x | | | | | | |
| 147 | *Escherichia coli* KTE153 | x | | | | | | |
| 148 | *Escherichia coli* KTE211 | x | | | | | | |
| 149 | *Escherichia coli* KTE218 | x | | | | | | |
| 150 | *Escherichia coli* KTE234 | x | | | | | | |
| 151 | *Escherichia coli* KTE47 | x | | | | | | |
| 152 | *Escherichia coli* KTE53 | x | | | | | | |
| 153 | *Escherichia coli* KTE6 | x | | | | | | |
| 154 | *Escherichia coli* MS 69-1 | x | | | | | | |
| 155 | *Escherichia coli* O10:K5(L):H4 str. ATCC 23506 | x | | | | | | |
| 156 | *Escherichia coli* O111 H 11128 uid41023 | x | | | | | | |
| 157 | *Escherichia coli* O111:H8 str. CVM9570 | x | | | | | | |
| 158 | *Escherichia coli* O111:H8 str. CVM9574 | x | | | | | | |

TABLE 16-continued

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 159 | *Escherichia coli* O111:H8 str. CVM9602 | x | | | | | | |
| 160 | *Escherichia coli* O111:H8 str. CVM9634 | x | | | | | | |
| 161 | *Escherichia coli* O113:H21 str. CL-3 | x | | | | | | |
| 162 | *Escherichia coli* O25b:ST131 str. JIE186 | x | | | | | | |
| 163 | *Escherichia coli* OK1180 | x | | | | | | |
| 164 | *Escherichia coli* S17 | x | | | | | | |
| 165 | *Escherichia coli* STEC_94C | x | | | | | | |
| 166 | *Escherichia coli* TW10828 | x | | | | | | |
| 167 | *Escherichia fergusonii* ATCC 35469 uid59375 | x | | | | | | |
| 168 | *Eubacterium cellulosolvens* 6 | x | | | | | | |
| 169 | *Exiguobacterium sibiricum* 255 15 uid58053 | x | | | | | | |
| 170 | *Faecalibacterium prausnitzii* A2-165 | x | | | | | | |
| 171 | *Faecalibacterium prausnitzii* M21/2 | x | | | | | | |
| 172 | *Flavobacterium branchiophilum* FL 15 uid73421 | x | | | | | | |
| 173 | *Fulvimarina pelagi* HTCC2506 | x | | | | | | |
| 174 | *Fusobacterium nucleatum* subsp. *nucleatum* ATCC 23726 | x | | | | | | |
| 175 | *Fusobacterium* sp. 11_3_2 | x | | | | | | |
| 176 | *Fusobacterium* sp. 2_1_31 | x | | | | | | |
| 177 | *Fusobacterium* sp. 3_1_27 | x | | | | | | |
| 178 | *Fusobacterium* sp. 3_1_5R | x | | | | | | |
| 179 | *Fusobacterium* sp. 7_1 | x | | | | | | |
| 180 | *Fusobacterium ulcerans* ATCC 49185 | x | | | | | | |
| 181 | gamma proteobacterium BDW918 | x | | | | | | |
| 182 | gamma proteobacterium IMCC3088 | x | | | | | | |
| 183 | *Geobacillus* sp. G11MC16 | x | | | | | | |
| 184 | *Geobacillus thermoglucosidan* | x | | | | | | |
| 185 | *Geobacillus* WCH70 uid59045 | x | | | | | | |
| 186 | *Geobacter sulfurreducens* PCA uid57743 | x | | | | | | |
| 187 | *Glaciecola lipolytica* E3 | x | | | | | | |
| 188 | *Glaciecola polaris* LMG 21857 | x | | | | | | |
| 189 | *Glaciecola punicea* DSM 14233 = ACAM 611 | x | | | | | | |
| 190 | *Haliscomenobacter hydrossis* DSM 1100 uid66777 | x | | | | | | |
| 191 | *Haloarcula japonica* DSM 6131 | x | | | | | | |
| 192 | *Halobacillus halophilus* DSM 2266 uid162033 | x | | | | | | |
| 193 | *Halobacteroides halobius* DSM 5150 uid184862 | x | | | | | | |
| 194 | *Halomonas* sp. HAL1 | x | | | | | | |
| 195 | *Holdemania filiformis* DSM 12042 | x | | | | | | |
| 196 | *Holophaga foetida* DSM 6591 | x | | | | | | |
| 197 | *Johnsonella ignava* ATCC 51276 | x | | | | | | |
| 198 | *Klebsiella oxytoca* E718 uid170256 | x | | | | | | |
| 199 | *Lachnoanaerobaculum* (*Eubacterium*) *saburreum* DSM 3986 | x | | | | | | |
| 200 | *Lachnoanaerobaculum* (*Eubacterium*) *saburreum* F0468 | x | | | | | | |
| 201 | Lachnospiraceae *bacterium* 1_1_57FAA | x | | | | | | |
| 202 | Lachnospiraceae *bacterium* 8_1_57FAA | x | | | | | | |
| 203 | Lachnospiraceae *bacterium* oral taxon 082 str | x | | | | | | |
| 204 | Lachnospiraceae oral taxon 107 str | x | | | | | | |
| 205 | *Lactobacillus amylovorus* GRL1118 uid160233 | x | | | | | | |
| 206 | *Lactobacillus casei* Lpc-37 | x | | | | | | |
| 207 | *Lactobacillus casei* UW4 | x | | | | | | |
| 208 | *Lactobacillus casei* Zhang uid50673 | x | | | | | | |
| 209 | *Lactobacillus helveticus* DSM 20075 | x | | | | | | |
| 210 | *Lactobacillus helveticus* H10 uid162017 | x | | | | | | |
| 211 | *Lactobacillus helveticus* R0052 uid174439 | x | | | | | | |
| 212 | *Lactobacillus johnsonii* ATCC 33200 | x | | | | | | |
| 213 | *Lactobacillus johnsonii* FI9785 uid41735 | x | | | | | | |
| 214 | *Lactobacillus reuteri* CF48-3A | x | | | | | | |
| 215 | *Lactobacillus reuteri* SD2112 uid55357 | x | | | | | | |
| 216 | *Lactobacillus rhamnosus* GG uid161983 | x | | | | | | |
| 217 | *Lactobacillus rhamnosus* GG uid59313 | x | | | | | | |
| 218 | *Lactobacillus rhamnosus* LRHMDP2 | x | | | | | | |
| 219 | *Lactobacillus rhamnosus* LRHMDP3 | x | | | | | | |
| 220 | *Lactobacillus zeae* KCTC 3804 | x | | | | | | |
| 221 | *Leuconostoc kimchii* IMSNU 11154 uid48589 | x | | | | | | |

TABLE 16-continued

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 222 | *Magnetospirillum magneticum* AMB 1 uid58527 | x | | | | | | |
| 223 | *Marinobacter aquaeolei* VT8 uid59419 | x | | | | | | |
| 224 | *Methanobrevibacter smithii* ATCC 35061 uid58827 | x | | | | | | |
| 225 | *Methanoculleus bourgensis* MS2 uid171377 | x | | | | | | |
| 226 | *Methanolobus psychrophilus* R15 uid177925 | x | | | | | | |
| 227 | *Methanomethylovorans hollandica* DSM 15978 uid184864 | x | | | | | | |
| 228 | *Methanosarcina acetivorans* C2A uid57879 | x | | | | | | |
| 229 | *Methanosarcina mazei* Go1 uid57893 | x | | | | | | |
| 230 | *Methylophaga aminisulfidivorans* MP | x | | | | | | |
| 231 | *Microcystis aeruginosa* PCC 9443 | x | | | | | | |
| 232 | *Nitratireductor indicus* C115 | x | | | | | | |
| 233 | *Nostoc punctiforme* PCC 73102 uid57767 | x | | | | | | |
| 234 | Opitutacea | x | | | | | | |
| 235 | *Oribacterium* sp. ACB1 | x | | | | | | |
| 236 | *Oribacterium* sp. ACB7 | x | | | | | | |
| 237 | *Oribacterium* sp. ACB8 | x | | | | | | |
| 238 | *Paenibacillus elgii* B69 | x | | | | | | |
| 239 | *Pantoea* sp. GM01 | x | | | | | | |
| 240 | *Parabacteroides* sp. D25 | x | | | | | | |
| 241 | *Parvularcula bermudensis* HTCC2503 uid51641 | x | | | | | | |
| 242 | *Pectobacterium carotovorum* PCC21 uid174335 | x | | | | | | |
| 243 | *Pectobacterium wasabiae* CFBP 3304 | x | | | | | | |
| 244 | *Pelobacter propionicus* DSM 2379 uid58255 | x | | | | | | |
| 245 | *Pelodictyon phaeoclathratiforme* BU 1 uid58173 | x | | | | | | |
| 246 | *Photobacterium* sp. SKA34 | x | | | | | | |
| 247 | *Photorhabdus asymbiotica* uid59243 | x | | | | | | |
| 248 | *Polaromonas* JS666 uid58207 | x | | | | | | |
| 249 | *Proteus mirabilis* WGLW6 | x | | | | | | |
| 250 | *Pseudoalteromona* | x | | | | | | |
| 251 | *Pseudoalteromonas luteoviolacea* B = ATCC 29581 | x | | | | | | |
| 252 | *Pseudomonas brassicacearum* NFM421 uid66303 | x | | | | | | |
| 253 | *Pseudomonas fragi* A22 | x | | | | | | |
| 254 | *Pseudomonas fuscovaginae* UPB0736 | x | | | | | | |
| 255 | *Pseudomonas mandelii* JR-1 | x | | | | | | |
| 256 | *Pseudomonas psychrotolerans* L19 | x | | | | | | |
| 257 | *Pseudomonas stutzeri* CCUG 29243 uid168379 | x | | | | | | |
| 258 | *Pseudomonas syringae* Lz4W | x | | | | | | |
| 259 | *Psychrobacter cryohalolentis* K5 uid58373 | x | | | | | | |
| 260 | *Rhodobacter sphaeroides* ATCC 17025 uid58451 | x | | | | | | |
| 261 | *Rhodococcus erythropolis* PR4 uid59019 | x | | | | | | |
| 262 | *Rhodopseudomonas palustris* TIE 1 uid58995 | x | | | | | | |
| 263 | *Roseburia inulinivorans* DSM 16841 | x | | | | | | |
| 264 | *Roseobacter* sp. MED193 | x | | | | | | |
| 265 | Ruminococcaceae *bacterium* D16 | x | | | | | | |
| 266 | *Runella slithyformis* DSM 19594 uid68317 | x | | | | | | |
| 267 | *Saccharophagus degradans* 2 40 uid57921 | x | | | | | | |
| 268 | *Salmonella enterica* serovar *Typhimurium* 14028S uid86059 | x | | | | | | |
| 269 | *Salmonella enterica* serovar *Typhimurium* 798 uid158047 | x | | | | | | |
| 270 | *Salmonella enterica* serovar *Typhimurium* LT2 uid57799 | x | | | | | | |
| 271 | *Salmonella enterica* serovar *Typhimurium* SL1344 uid86645 | x | | | | | | |
| 272 | *Salmonella enterica* serovar *Typhimurium* ST1660 06 uid190371 | x | | | | | | |
| 273 | *Salmonella enterica* serovar *Typhimurium* ST4 74 uid84393 | x | | | | | | |
| 274 | *Salmonella enterica* serovar *Typhimurium* STm1 uid181283 | x | | | | | | |
| 275 | *Salmonella enterica* serovar *Typhimurium* STm12 uid181362 | x | | | | | | |

TABLE 16-continued

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 276 | *Salmonella enterica* serovar *Typhimurium* STm2 uid181284 | x | | | | | | |
| 277 | *Salmonella enterica* serovar *Typhimurium* STm3 uid181357 | x | | | | | | |
| 278 | *Salmonella enterica* serovar *Typhimurium* STm4 uid181358 | x | | | | | | |
| 279 | *Salmonella enterica* serovar *Typhimurium* STm8 uid181355 | x | | | | | | |
| 280 | *Salmonella enterica* serovar *Typhimurium* STm9 uid181356 | x | | | | | | |
| 281 | *Salmonella enterica* serovar *Typhimurium* T000240 uid84397 | x | | | | | | |
| 282 | *Salmonella enterica* serovar *Typhimurium* uid86061 | x | | | | | | |
| 283 | *Salmonella enterica* serovar *Typhimurium* UK 1 uid87049 | x | | | | | | |
| 284 | *Salmonella enterica* subsp. *enterica* serovar 4,[5],12:i:- str. CVM23701 | x | | | | | | |
| 285 | *Salmonella enterica* subsp. *enterica* serovar Enteritidi | x | | | | | | |
| 286 | *Salmonella enterica* subsp. *enterica* serovar Infanti | x | | | | | | |
| 287 | *Salmonella enterica* subsp. *enterica* serovar Saintpau | x | | | | | | |
| 288 | *Salmonella enterica* subsp. *enterica* serovar Typhimuriu | x | | | | | | |
| 289 | *Salmonella enterica* subsp. *enterica* serovar Uganda str | x | | | | | | |
| 290 | *Selenomonas sputigena* ATCC 35185 | x | | | | | | |
| 291 | *Selenomonas sputigena* ATCC 35185 uid55329 | x | | | | | | |
| 292 | *Shewanella* ANA 3 uid58347 | x | | | | | | |
| 293 | *Shewanella baltica* OS625 | x | | | | | | |
| 294 | *Shewanella* MR 4 uid58345 | x | | | | | | |
| 295 | *Sinorhizobium meliloti* CCNWSX0020 | x | | | | | | |
| 296 | *Slackia heliotrinireducens* DSM 20476 uid59051 | x | | | | | | |
| 297 | *Sphingobium indicum* B90A | x | | | | | | |
| 298 | *Sphingobium yanoikuyae* XLDN2-5 | x | | | | | | |
| 299 | *Spirosoma linguale* DSM 74 uid43413 | x | | | | | | |
| 300 | *Sporolactobacillus vineae* DSM 21990 = SL153 | x | | | | | | |
| 301 | *Sporosarcina newyorkensis* 2681 | x | | | | | | |
| 302 | *Streptomyces* sp. SPB78 | x | | | | | | |
| 303 | *Sulfuricurvum kujiense* DSM 16994 uid60789 | x | | | | | | |
| 304 | *Synechococcus* PCC 6312 uid182934 | x | | | | | | |
| 305 | *Syntrophus aciditrophicus* SB uid58539 | x | | | | | | |
| 306 | *Thauera* MZ1T uid58987 | x | | | | | | |
| 307 | *Thermacetogenium phaeum* DSM 12270 uid177811 | x | | | | | | |
| 308 | *Thermoanaerobacterium thermosaccharolyticum* DSM 571 uid51639 | x | | | | | | |
| 309 | *Thiocystis violascens* DSM 198 uid74025 | x | | | | | | |
| 310 | *Thioflavicoccus mobilis* 8321 uid184343 | x | | | | | | |
| 311 | *Thiothrix nivea* DSM 5205 | x | | | | | | |
| 312 | *Vibrio cholera* CIRS 101 | x | | | | | | |
| 313 | *Vibrio cholerae* 4260B | x | | | | | | |
| 314 | *Vibrio cholerae* CP1035(8) | x | | | | | | |
| 315 | *Vibrio cholerae* CP1048(21) | x | | | | | | |
| 316 | *Vibrio cholerae* CP1050(23) | x | | | | | | |
| 317 | *Vibrio cholerae* H1 | x | | | | | | |
| 318 | *Vibrio cholerae* HC-17A1 | x | | | | | | |
| 319 | *Vibrio cholerae* HC-17A2 | x | | | | | | |
| 320 | *Vibrio cholerae* HC-19A1 | x | | | | | | |
| 321 | *Vibrio cholerae* HC-22A1 | x | | | | | | |
| 322 | *Vibrio cholerae* HC-23A1 | x | | | | | | |
| 323 | *Vibrio cholerae* HC-28A1 | x | | | | | | |
| 324 | *Vibrio cholerae* HC-32A1 | x | | | | | | |
| 325 | *Vibrio cholerae* HC-37A1 | x | | | | | | |
| 326 | *Vibrio cholerae* HC-38A1 | x | | | | | | |
| 327 | *Vibrio cholerae* HC-39A1 | x | | | | | | |
| 328 | *Vibrio cholerae* HC-40A1 | x | | | | | | |
| 329 | *Vibrio cholerae* HC-41A1 | x | | | | | | |
| 330 | *Vibrio cholerae* HC-43A1 | x | | | | | | |

TABLE 16-continued

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 331 | *Vibrio cholerae* HC-46A1 | x | | | | | | |
| 332 | *Vibrio cholerae* HC-47A1 | x | | | | | | |
| 333 | *Vibrio cholerae* HC-48A1 | x | | | | | | |
| 334 | *Vibrio cholerae* HC-48B2 | x | | | | | | |
| 335 | *Vibrio cholerae* HC-49A2 | x | | | | | | |
| 336 | *Vibrio cholerae* HC-55B2 | x | | | | | | |
| 337 | *Vibrio cholerae* HC-56A2 | x | | | | | | |
| 338 | *Vibrio cholerae* HC-57A2 | x | | | | | | |
| 339 | *Vibrio cholerae* HC-60A1 | x | | | | | | |
| 340 | *Vibrio cholerae* HC-61A1 | x | | | | | | |
| 341 | *Vibrio cholerae* HC-61A2 | x | | | | | | |
| 342 | *Vibrio cholerae* HC-62A1 | x | | | | | | |
| 343 | *Vibrio cholerae* HC-62B1 | x | | | | | | |
| 344 | *Vibrio cholerae* HC-64A1 | x | | | | | | |
| 345 | *Vibrio cholerae* HC-65A1 | x | | | | | | |
| 346 | *Vibrio cholerae* HC-67A1 | x | | | | | | |
| 347 | *Vibrio cholerae* HC-68A1 | x | | | | | | |
| 348 | *Vibrio cholerae* HC-69A1 | x | | | | | | |
| 349 | *Vibrio cholerae* HC-70A1 | x | | | | | | |
| 350 | *Vibrio cholerae* HC-71A1 | x | | | | | | |
| 351 | *Vibrio cholerae* HC-72A2 | x | | | | | | |
| 352 | *Vibrio cholerae* HC-77A1 | x | | | | | | |
| 353 | *Vibrio cholerae* HC-7A1 | x | | | | | | |
| 354 | *Vibrio cholerae* HC-80A1 | x | | | | | | |
| 355 | *Vibrio cholerae* HC-81A1 | x | | | | | | |
| 356 | *Vibrio cholerae* HC-81A2 | x | | | | | | |
| 357 | *Vibrio cholerae* HCUF01 | x | | | | | | |
| 358 | *Vibrio cholerae* HFU-02 | x | | | | | | |
| 359 | *Vibrio cholerae* MJ 1236 uid59387 | x | | | | | | |
| 360 | *Vibrio cholerae* MO10 | x | | | | | | |
| 361 | *Vibrio cholerae* O1 2010EL 1786 uid78933 | x | | | | | | |
| 362 | *Vibrio cholerae* O1 str. 2010EL-1792 | x | | | | | | |
| 363 | *Vibrio cholerae* O1 str. 2010EL-1798 | x | | | | | | |
| 364 | *Vibrio cholerae* O1 str. EC-0009 | x | | | | | | |
| 365 | *Vibrio cholerae* O1 str. EC-0012 | x | | | | | | |
| 366 | *Vibrio cholerae* O1 str. EC-0027 | x | | | | | | |
| 367 | *Vibrio cholerae* O1 str. EDC-020 | x | | | | | | |
| 368 | *Vibrio cholerae* O1 str. EM-1546 | x | | | | | | |
| 369 | *Vibrio cholerae* O1 str. Inaba G4222 | x | | | | | | |
| 370 | *Vibrio cholerae* O1 str. Nep-21106 | x | | | | | | |
| 371 | *Vibrio cholerae* O1 str. Nep-21113 | x | | | | | | |
| 372 | *Vibrio cholerae* O1 str. NHCC-004A | x | | | | | | |
| 373 | *Vibrio cholerae* O1 str. NHCC-006C | x | | | | | | |
| 374 | *Vibrio cholerae* O1 str. NHCC-010F | x | | | | | | |
| 375 | *Vibrio cholerae* O1 str. PCS-023 | x | | | | | | |
| 376 | *Vibrio cholerae* VC4370 | x | | | | | | |
| 377 | *Vibrio harveyi* CAIM 1792 | x | | | | | | |
| 378 | *Vibrio shilonii* AK1 | x | | | | | | |
| 379 | *Vibrio tubiashii* ATCC 19109 | x | | | | | | |
| 380 | *Vibrio cholerae* HC-20A2 | x | | | | | | |
| 381 | *Vibrio cholerae* HC-21A1 | x | | | | | | |
| 382 | *Vibrio cholerae* HC-42A1 | x | | | | | | |
| 383 | *Vibrio cholerae* HC-51A1 | x | | | | | | |
| 384 | *Vibrio cholerae* O1 str. 3582-05 | x | | | | | | |
| 385 | *Xanthomonas vesicatoria* ATCC 35937 | x | | | | | | |
| 386 | *Yersinia ruckeri* ATCC 29473 | x | | | | | | |
| 387 | *Zymomonas mobilis* NCIMB 11163 uid41019 | x | | | | | | |
| 388 | *Clostridium clariflavum* DSM 19732 uid82345 | xx | | | | | | Genome contains two BREX systems of type #1 |
| 389 | *Clostridium saccharolyticum* WM1 uid51419 | xx | | | | | | Genome contains two BREX systems of type #1 |
| 390 | *Fusobacterium necrophorum* subsp | xx | | | | | | Genome contains two BREX systems of type #1 |
| 391 | *Gallionella capsiferriformans* ES 2 uid51505 | xx | | | | | | Genome contains two BREX systems of type #1 |
| 392 | *Magnetospirillum* sp. SO-1 | xx | | | | | | Genome contains two BREX systems of type #1 |
| 393 | *Methanoplanu* | xx | | | | | | Genome contains two BREX systems of type #1 |
| 394 | *Methanospirillum hungatei* JF 1 uid58181 | xx | | | | | | Genome contains two BREX systems of type #1 |
| 395 | *Salmonella enterica* serovar *Typhimurium* STm11 uid181361 | xx | | | | | | Genome contains two BREX systems of type #1 |

TABLE 16-continued

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 396 | *Stomatobaculum longum* (Lachnospiraceae bacterium ACC2) | xx | | | | | | Genome contains two BREX systems of type #1 |
| 397 | *Syntrophomonas wolfei* Goettingen uid58179 | xx | | | | | | Genome contains two BREX systems of type #1 |
| 398 | *Vibrio cholerae* B33 | xx | | | | | | Genome contains two BREX systems of type #1 |
| 399 | *Haloarcula argentinensis* DSM 12282 | | x | | | | | |
| 400 | *Haloarcula hispanica* ATCC 33960 uid72475 | | x | | | | | |
| 401 | *Halobacterium salinarum* R1 uid61571 | | x | | | | | |
| 402 | *halophilic archaeon* DL31 uid72619 | | x | | | | | |
| 403 | *Halopiger xanaduensis* SH6 uid68105 | | x | | | | | |
| 404 | *Halorhabdus utahensis* DSM 12940 uid59189 | | x | | | | | |
| 405 | *Halorubrumlacus profundi* ATCC 49239 uid58807 | | x | | | | | |
| 406 | *Halosimplex carlsbadense* 2-9-1 | | x | | | | | |
| 407 | *Natrinema pellirubrum* DSM 15624 uid74437 | | x | | | | | |
| 408 | *Natronorubrum tibetense* GA33 | | x | | | | | |
| 409 | *Anaeromyxobacter dehalogenans* 2CP 1 uid58989 | | | x | | | | |
| 410 | *Planctomyces limnophilus* DSM 3776 uid48643 | | | x | | | | |
| 411 | *Rhodopirellula* sp. SWK7 | | | x | | | | |
| 412 | *Haliangium ochraceum* DSM 14365 uid41425 | | | xx | | x | | Genome contains two BREX systems of type #6 and one ot type #2 |
| 413 | *Nitrococcus mobilis* Nb-231 | | | | x | x | | Genome contains two BREX systems: #3 and #2 |
| 414 | *Anaerobaculum mobile* DSM 13181 uid168323 | | | | x | | x | Genome contains two BREX systems: #3 and #4 |
| 415 | *Acetohalobium arabaticum* DSM 5501 uid51423 | | | | x | | | |
| 416 | *Acidothermus cellulolyticus* 11B uid58501 | | | | x | | | |
| 417 | *Alcanivorax hongdengensis* A-11-3 | | | | x | | | |
| 418 | *Bacillus cereus* 03BB108 | | | | x | | | |
| 419 | *Bacillus cereus* BAG2X1-1 | | | | x | | | |
| 420 | *Bacillus methanolicus* MGA3 | | | | x | | | |
| 421 | *Bacillus cereus* W | | | | x | | | |
| 422 | *Bacteroides vulgatus* ATCC 8482 uid58253 | | | | x | | | |
| 423 | *Caldicellulosiruptor kristjanssonii* 177R1B uid60393 | | | | x | | | |
| 424 | *Caloramator australicus* RC3]Length = 15 | | | | x | | | |
| 425 | *Chloroflexus aggregans* DSM 9485 uid58621 | | | | x | | | |
| 426 | *Clostridium papyrosolvens* DSM 2782 | | | | x | | | |
| 427 | *Clostridium thermocellum* YS | | | | x | | | |
| 428 | *Desulfotomaculum nigrificans* DSM 574 | | | | x | | | |
| 429 | *Desulfovibrio aespoeensis* Aspo 2 uid42613 | | | | x | | | |
| 430 | *Dethiosulfovibrio peptidovorans* DSM 11002 | | | | x | | | |
| 431 | *Dichelobacter nodosus* VCS1703A uid57643 | | | | x | | | |
| 432 | *Ectothiorhodospir* | | | | x | | | |
| 433 | *Enterococcus faecium* 1,231,501 | | | | x | | | |
| 434 | *Kingella denitrificans* ATCC 33394 | | | | x | | | |
| 435 | *Lachnospiraceae bacteriu* | | | | x | | | |
| 436 | *Methanocaldococcus* FS406 22 uid42499 | | | | x | | | |
| 437 | *Methanosalsum zhilinae* DSM 4017 uid68249 | | | | x | | | |
| 438 | *Methylacidiphilum infernorum* V4 uid59161 | | | | x | | | |
| 439 | *Methyloversatilis universalis* FAM5 | | | | x | | | |
| 440 | *Nitrosococcus oceani* AFC27 | | | | x | | | |
| 441 | *Nitrosococcus oceani* ATCC 19707 uid58403 | | | | x | | | |
| 442 | *Nitrosococcus watsonii* C 113 uid50331 | | | | x | | | |
| 443 | *Pelotomaculum thermopropionicum* SI uid58877 | | | | x | | | |
| 444 | *Planctomyces brasiliensis* DSM 5305 uid60583 | | | | x | | | |
| 445 | planctomycete KSU-1 | | | | x | | | |
| 446 | *Pseudoalteromonas marina* mano4 | | | | x | | | |
| 447 | *Pseudomonas* sp. GM55 | | | | x | | | |

TABLE 16-continued

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 448 | *Syntrophothermus lipocalidus* DSM 12680 uid49527 | | | | x | | | |
| 449 | *Thermanaerovibrio acidaminovorans* DSM 6589 uid41925 | | | | x | | | |
| 450 | *Thermoanaerobacter brockii finnii* Ako 1 uid55639 | | | | x | | | |
| 451 | *Thermoanaerobacter ethanolicus* CCSD1 | | | | x | | | |
| 452 | *Thermoanaerobacter ethanolicus* JW 200 | | | | x | | | |
| 453 | *Thermoanaerobacter italicus* Ab9 uid46241 | | | | x | | | |
| 454 | *Thermoanaerobacter pseudethanolicus* ATCC 33223 uid58339 | | | | x | | | |
| 455 | *Thermoanaerobacterium saccharolyticum* JW SL YS485 uid167781 | | | | x | | | |
| 456 | *Thermoanaerobacterium thermosaccharolyticum* M0795 uid184821 | | | | x | | | |
| 457 | *Thermoanaerobacterium xylanolyticum* LX 11 uid63163 | | | | x | | | |
| 458 | *Thermoplasmatales archaeon* SCGC AB-539-N05 | | | | x | | | |
| 459 | *Treponema primitia* ZAS-1 | | | | x | | | |
| 460 | *Vibrio scophthalmi* LMG 19158 | | | | x | | | |
| 461 | *Parvibaculum lavamentivorans* DS 1 uid58739 | | | | xx | | | Genome contains two BREX systems of type #3 |
| 462 | *Amycolatopsis azurea* DSM 43854 | | | | | x | | |
| 463 | *Bradyrhizobium* sp. ORS 375 | | | | | x | | |
| 464 | *Burkholderia thailandensis* E264 | | | | | x | | |
| 465 | *Burkholderia thailandensis* E264 uid58081 | | | | | x | | |
| 466 | *Candidatus Accumulibacter phosphatis* clade IIA UW 1 uid59207 | | | | | x | | |
| 467 | *Corallococcus coralloides* DSM 2259 uid157997 | | | | | x | | |
| 468 | *Corynebacterium variabile* DSM 44702 uid62003 | | | | | x | | |
| 469 | *Dietzia cinnamea* P4 | | | | | x | | |
| 470 | *Frankia* CcI3 uid58397 | | | | | x | | |
| 471 | *Frankia* EuI1c uid42615 | | | | | x | | |
| 472 | *Frankia* sp. EUN1f | | | | | x | | |
| 473 | *Gemmata obscuriglobus* UQM 2246 | | | | | x | | |
| 474 | *Gordonia amicalis* NBRC 100051 = JCM 11271 | | | | | x | | |
| 475 | *Gordonia polyisoprenivorans* NBRC 16320 | | | | | x | | |
| 476 | *Hahella chejuensis* KCTC 2396 uid58483 | | | | | x | | |
| 477 | *Micromonospora aurantiaca* ATCC 27029 uid42501 | | | | | x | | |
| 478 | *Micromonospora* sp. ATCC 39149 | | | | | x | | |
| 479 | *Mycobacterium gilvum* PYR GCK uid59421 | | | | | x | | |
| 480 | *Mycobacterium xenopi* RIVM700367 | | | | | x | | |
| 481 | *Mycobacterium intracellulare* ATCC 13950 | | | | | x | | |
| 482 | *Nocardia cyriacigeorgica* GUH 2 uid89395 | | | | | x | | |
| 483 | *Phaeospirillum molischianum* DSM 120 | | | | | x | | |
| 484 | *Planctomyces maris* DSM 8797 | | | | | x | | |
| 485 | *Polaromonas naphthalenivorans* CJ2 uid58273 | | | | | x | | |
| 486 | *Pseudomonas stutzeri* NF13 | | | | | x | | |
| 487 | *Rhodococcus triatomae* BKS 15-14 | | | | | x | | |
| 488 | *Rhodococcus ruber* BKS 20-38 | | | | | x | | |
| 489 | *Saccharomonospora cyanea* NA-134 | | | | | x | | |
| 490 | *Saccharomonospora glauca* K62 | | | | | x | | |
| 491 | *Saccharomonospora viridis* DSM 43017 uid59055 | | | | | x | | |
| 492 | *Saccharomonospora xinjiangensis* XJ-54 | | | | | x | | |
| 493 | *Saccharopolyspora erythraea* NRRL 2338 | | | | | x | | |
| 494 | *Saccharopolyspora erythraea* NRRL 2338 uid62947 | | | | | x | | |
| 495 | *Saccharothrix espanaensis* DSM 44229 uid184826 | | | | | x | | |
| 496 | *Singulisphaera acidiphila* DSM 18658 uid81777 | | | | | x | | |
| 497 | *Sorangium cellulosum* So ce 56 uid61629 | | | | | x | | |
| 498 | *Streptomyces coelicolor* A3 2 uid57801 | | | | | x | | |
| 499 | *Streptomyces griseus* NBRC 13350 uid58983 | | | | | x | | |
| 500 | *Streptomyces turgidiscabies* Car8 | | | | | x | | |
| 501 | *Streptomyces gancidicus* BKS 13-15 | | | | | x | | |

TABLE 16-continued

Summary of distribution of BREX types across genomes

| | Organism | BREX #1 | BREX #5 | BREX #6 | BREX #3 | BREX #2 | BREX #4 | Comments |
|---|---|---|---|---|---|---|---|---|
| 502 | Thermobifida fusca YX uid57703 | | | | | x | | |
| 503 | Thermobispora bispora DSM 43833 uid48999 | | | | | x | | |
| 504 | Aciduliprofundum MAR08 339 uid184407 | | | | | | x | |
| 505 | Candidatus Desulforudis audaxviator MP104C uid59067 | | | | | | x | |
| 506 | Coprothermobacter proteolyticus DSM 5265 uid59253 | | | | | | x | |
| 507 | Cyanobacterium stanieri PCC 7202 uid183337 | | | | | | x | |
| 508 | Denitrovibrio acetiphilus DSM 12809 uid46657 | | | | | | x | |
| 509 | Desulfitobacterium dichloroeliminans LMG P 21439 uid82555 | | | | | | x | |
| 510 | Geobacter M21 uid59037 | | | | | | x | |
| 511 | Prevotella denticola F0289 uid65091 | | | | | | x | |
| 512 | Thermomicrobium roseum DSM 5159 uid59341 | | | | | | x | |
| 513 | Thermotoga petrophila RKU 1 uid58655 | | | | | | x | |
| 514 | Thioalkalivibrio sp. K90mix | x | | | | | | |

As used herein the term "about" refers to ±10%.

The terms "comprises", "comprising", "includes", "including", "having", and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion. Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology". John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N. Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames. B. D., and Higgins S. J., eds. (1985); "Transcription and Translation" Hames. B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Materials and Methods

Genomic Data and Molecular Phylogeny of the pglZ Protein—

A set of 1447 completely sequenced prokaryotic genomes (1336 bacterial and 111 archaeal genomes) were downloaded from the NCBI FTP site (ftp://ftp.ncbi.nih.gov/genomes/Bacteria/) and used for subsequent analyses. Several pglZ protein sequences were used as a query in a PSI-BLAST search against the 1447 prokaryotic genomes with an inclusion threshold e-value of 0.001. Proteins that did not contain the pglZ domain or that were <600 amino acids length were filtered out. The remaining protein sequences were used to build a pglZ tree as follows: Amino acid sequences were aligned using the MAFFT algorithm [Katoh et al. Nucleic acids research (2002) 30: 3059-3066]. The Fourier transform approximation was disabled, and substitution rates were modeled with JTT [Jones et al. Computer applications in the biosciences: CABIOS (1992) 8: 275-282] and BLOSUM45 matrix, which is suitable for diverged sequences. The gene tree was reconstructed using the probabilistic RAxML algorithm, with 100 bootstrap replicates, substitutions modeled with JTT (Jones et al. 1992), while allowing for rate variability among sites. For simplicity, the tree presented in FIG. 1A shows only the 115 pglZ protein sequences that are part of a complete Bacteriophage Exclusion (BREX) system. The brxC/pglY phylogeny tree was built in the same manner.

Identification of Bacteriophage Exclusion (BREX) Types 1-6

System types were characterized based on manual observation of phyletic clusters in the pglZ tree. The specific genes associated with each pglZ phyletic type were defined using the IMG genome browser (www://img(dot)jgi(dot)doe(dot)gov/cgi-bin/w/main(dot)cgi). A representative protein sequence of each of the individual genes (Table 1 below) was then used as query in a PSI-BLAST search with an inclusion threshold e-value of 0.05. Only gene clusters containing the two core genes (pglz and brxC/pglY) and at least two additional genes were considered, under the added constraint that the genomic distance between the first and last genes in the system be under 30 kb. In the case of pglY, homology was based on the shared motifs (the p-loop motif GXXXXGK(T/S) (DUF2791, SEQ ID NO: 6162) and DUF499 combined with the conserved size of the gene in the different subtypes (1200 amino acids). The filtered clusters were manually assigned to systems according to gene content. Only clusters containing the complete set of genes or missing one non-core gene were included in the final set (Tables 2-7 below). In the case of BREX type 2, systems missing both brxD and brxHI were also included in the final set. The blastx program was used to scan intergenic regions in the clusters for unnanotated genes. Protein domains were annotated using the conserved domain database (CDD)[34] and HHpred[35]. In the latter case, queries were carried out using representative sequences against the PDB, SCOP, interpro, pfam, smart, tigrfam and COG databases using default search parameters. The blastx program was used to scan intergenic regions in the clusters for un-annotated genes.

The consensus organisms tree (represented in FIG. 1A-B) was derived from the NCBI "common tree" downloaded from the NCBI Taxonomy portal. In order to check whether subtypes were overrepresented in specific bacterial phyla the two following ratios were compared, using a hypergeometric statistical test: (i) Number of instances of a specific subtype in a specific phylum/total number of the specific subtype in bacteria; (ii) Total number of genomes of the specific phylum analyzed/total number of bacterial genomes analyzed. P-value ≤0.05 was considered statistically significant following Benjamini and Hochberg correction for multiple testing.

Extensive Identification of BREX Systems in Prokaryotic Genomes

A set of 2263 completely sequenced prokaryotic genomes and 5493 draft genomes was downloaded from the NCBI FTP site (ftp://ftp.ncbi.nih.gov/genomes/Bacterial and ftp://ftp.ncbi.nih.gov/genomes/Bacteria_DRAFT/, respectively) and used for subsequent analyses. A representative protein sequence of each of the 13 genes (Table 1 below) was then used as query in a PSI-BLAST search against the 7756 completely sequences and draft genomes with an inclusion threshold e-value of 0.05. Only gene clusters containing the two core genes (pglZ and brxC/pglY) and at least two additional genes were considered and listed in tables 10-15 below.

Strain Construction—

The type 1 BREX system was amplified in fragments from the *Bacillus cereus* H3081.97 genome from position 89,288-103,514 (GenBank ABDL02000007.1, SEQ ID NO: 6164). The PCR-amplified fragments were assembled to a circular plasmid in *S. cerevisiae* using the pYES1L vector (Invitrogen), transformed into *Eccherichia coli* BL21 AI and amplified, and then integrated into the proB gene in *Bacillus subtilis* BEST7003, along with a chloramphenicol resistance cassette. The DNA sequence of the plasmid used for the integration is depicted in SEQ ID NO: 6139. The primers used for construction are depicted in SEQ ID NO: 6140-6151. The presence of the intact BREX system within *Basillus subtilis* BEST7003 was confirmed by PCR and Illumina-based whole genome sequencing. Primers sequences are depicted in SEQ ID NO: 6152-6161. Control strains contain only the chloramphenicol resistance cassette integrated at the proB locus. The pglX deletion strain was constructed in a similar manner with PCR fragments that created a deletion from position 94,655-98,163 (GenBank ABDLO2000007.1, SEQ ID NO: 6164), leaving only 31 nucleotides of the pglX gene. The DNA sequence of the plasmid used for the integration is depicted in SEQ ID NO: 6210.

Growth Dynamics of Phage Infected Cultures—

Overnight cultures were diluted 1:100 in LB media supplemented with 0.1 mM $MnCl_2$ and 5 mM $MgCl_2$ and then grown to an $OD_{600}$ of 0.06 in a 96-well plate format. Phages were added at a multiplicity of infection (MOI) ranging from $10^{-3}$ to $10^{-4}$. High concentration phage infections were performed at MOI ranging from 0.05 to 5. Optical density measurements at a wavelength of 600 nm were taken every 13 minutes using a TECAN infinite 2000 plate reader.

Plaque Assays—

Small drop plaque assays were initially performed using 0.75% agar plates containing bacterial cultures that were diluted 1:13 in LB media supplemented with 0.1 mM MnCl2 and 5 mM $MgCl_2$. Serial dilutions of the phage between $2 \times 10^0$ and $2 \times 10^5$ plaque-forming units (pfu) were spotted on these plates and plaques were counted after overnight growth at room temperature. Further confirmation of plaque numbers was performed by an agar overlay assay. The bottom agar was composed of LB media supplemented with 0.1 mM $MnCl_2$ and 5 mM $MgCl_2$ and 1.5% agar. The top agar was prepared by diluting overnight bacterial cultures 1:30 in LB media supplemented with 0.1 mM $MnCl_2$ and 5 mM $MgCl_2$ and 0.5% agar with the addition of serial dilutions of the phage. Plaques were counted after overnight growth at room temperature.

One-Step Phage Growth Curve Assays—

One-step phage growth curve experiments were performed as described by Carlson [E. Kutter and A. Sulakvelidze (ed.), Bacteriophages: biology and applications, CRC Press, Boca Raton. Fla. Appendix p. 437-494]. Logarithmic phase cultures were infected with either phage SPO1 or φ3T at an MOI of 0.05. Following 18 minutes of growth at 37° C. the infected culture was diluted 1:10,000, to reduce the likelihood of phage infection following cell lysis. To evaluate the number of infective centers and extracellular phage present in the infected culture, samples were taken at specific time points throughout the incubation period, mixed with a phage-sensitive *Basillus subtilis* strain and plated using the agar overlay method described hereinabove. Phage adsorption was inferred by evaluating the number of extracellular phage present in the mixture 15 minutes following infection. This was assayed by mixing the infection mixture with chloroform, incubating it at 37° C. for 4 minutes, followed by incubation for 4 minutes on ice, and 30 minutes at room temperature. The aqueous phase was then mixed with a phage-sensitive *Basillus subtilis* strain and plated using the agar overlay method described hereinabove. The addition of chloroform leads to bacteria killing, including phage adsorbed bacteria. At early time points, phage have not yet assembled inside the cell, and are therefore unable to form plaques. Thus, the derived results allow evaluation of the extracellular phage levels. A drop in extracellular phage levels indicates that adsorption has occurred.

DNA Extraction—

DNA extraction was performed by suspending cells in 50 mM EDTA pH 8.0 with a lytic enzyme (lysozyme. Sigma) for 90 minutes at 37° C. followed by centrifugation for 2 minutes at 13,000 g and removal of supernatant. The cells were then lysed by adding a Nuclei Lysis Solution (Promega, cat no. A7941) for 5 minutes at 80° C. followed by addition of Rnase A (10 mg/ml) for 30-60 minutes at 37° C. The protein fraction was precipitated by adding 200 µl Protein Precipitation Solution (Promega, cat no. A795A), incubating the suspension for 5 minutes on ice followed by centrifugation at 13,000-16,000 g for 3 minutes. The supernatant was then transferred to a clean tube containing 600 µl isopropanol, mixed and centrifuged at 13,000-16,000 g for 3 minutes. The supernatant was removed and 600 µl 70% Ethanol was added to the pellet mixed and centrifuged at 13,000-16,000 g for 3 minutes. The ethanol was then aspirated and the pellet was air dried for a couple of minutes followed by resuspension in Qiagen Elution buffer.

Phage Infection Time Courses, Genomic DNA Sequencing and Methylation Analysis—

Phage infection time course cultures for both methylome analysis, detection of lysogeny and relative phage abundance were performed at an MOI of 4. Phage infection time course cultures are practically cultures infected by phage and analyzed at specific time points (e.g. 0, 5, 10, 15, 20, 30 and 40 minutes following infection). Uninfected cultures analyzed at the same time points served as control. Cell pellets were washed three times in 10 mM Tris pH 7.4 to remove unadsorbed phage, followed by DNA extraction as described hereinabove. DNA library preparations and sequencing for methylome analysis were performed at the Yale Center for Genome Analysis (see Murray I A et al. (2012) Nucleic acids research 40: 11450-11462). To determine the relative abundance of bacterial and phage φ3T DNA levels, DNA was first fragmented using NEBNext® dsDNA Fragmentase (New England Biolabs Ibc.) according to manufacturer's instructions, followed by Illumina sequencing of the DNA libraries of φ3T phage-infected time course cultures. The sequences were mapped to the phage and host genomes as previously described [Wurtzel et al. PloS one (2010) 5: e15628]. Sequences shared by both *Basillus subtilis* BEST7003 and phage φ3T DNA were discarded from the dataset. The remaining mapped sequences were enumerated at each time point to compare the number of sequences mapped to the *Basillus subtilis* BEST7003 DNA relative to phage φ3T DNA and normalized to the genome size.

Detection of Phage Lysogeny—

Genomic DNA sequencing of a lysogen containing phage φ3T was performed using Illumina sequencing to determine the DNA sequence of the φ3T phage and the site of phage integration in the genome. The integration of the φ3T phage was determined at a GTAGG site on the *Basillus subtilis* BEST7003 bacterial genome at position 2106060-2106064. Multiplex PCR assays were used to detect phage φ3T DNA, *Basillus subtilis* BEST7003 DNA, and the novel junction created in the lysogenized strain. Primers used to detect phage φ3T were GAGGTTCGCTACGGGCGAAAT (SEQ ID NO: 6211) and TCTCTGCTTGATITCGTCCATGA (SEQ ID NO: 6212). Primers for detection of *Basillus subtilis* BEST7003 and the unique junction found in the lysogen were TGCCTGCATGAGCTGATITG (SEQ ID NO: 6213) and GCAGGAATGAATGGTGGATATTG (SEQ ID NO: 6214); and TCATGCTCCGGATTTGCGAT (SEQ ID NO: 6215) and TGCCTCCITTCGATITTGTTACC (SEQ ID NO: 6216), respectively.

Structural Homology Between brxA and NusB—

Alignment between brxA from *Magnetospirillum magneticum* (PDB entry 3BHW) and NusB from *Aquifex aelicus* (PDB entry 3R2C) was performed using the MultiProt web server and presented using PyMol (Schrödinger, Inc, Portland, Oreg., USA).

Agarose Gel and Southern Blot Analysis—

200 ng of undigested genomic DNA was run on a TAE agarose gel. The agarose gel was depurinated in 0.25 N HCl for 20 minutes, rinsed in ddH$_2$O, and soaked in denaturation buffer (0.5 M NaOH, 1.5 M NaCl) for 10 minutes. The DNA was then transferred onto HybondXL membrane (Amersham) by capillary transfer in denaturation buffer and the membranes were baked for 2 hours at 80° C. DNA for probes was labeled with $\alpha^{32}$P-dCTP using the High Prime Kit (Roche Cat no. 11 585 584 001) according to manufacturer's instructions. Phage φ3T specific primers were PTG111: TGGATTTCAGCTGGGGAAGA (SEQ ID NO: 6217) and PTG112: AACTTGTCTCTATCTTATCACCTGT (SEQ ID NO: 6218). The membranes were incubated overnight with the probe at 65° C. in hybridization buffer (7% SDS, 0.5 M NaPhosphate pH 7.2, 10 mM EDTA), washed twice with 2×SSC, 0.1% w/v SDS, washed twice with 1×SSC, 0.1% w/v SDS, then four times with 0.2×SSC, 0.1% w/v SDS and exposed to phosphorimager screen and visualized.

RNA sequencing and 5' and 3' RACE—were performed as described in Wurtzel O. et al. (2012) Molecular Systems Biology, 8:583.

Example 1

Bacteriophage Exclusion (BREX) System is Abundant in Bacteria and Archaea

Previous reports demonstrated that various combinations of genes belonging to the Phage Growth Limitation (PGL) system, and predominantly pglZ, were enriched within 'defense islands' of bacteria and archaea[9,13]. The present inventors have initially performed homology searches in 1447 bacterial and archaeal genomes in order to understand whether there is higher order organization amongst pglZ and its associated genes. These homology searches found 144 occurrences of pglZ amongst the 1447 bacterial and archaeal genomes analyzed. Phylogenetic tree reconstruction of these pglZ proteins showed clear clustering of pglZ into several defined phyletic groups (FIG. 1A). By analyzing the genomic context of pglZ in each of these groups, a distinct set of 13 genes strongly associated with pglZ was identified (Table 1 below). The composition and order of these genes were highly coherent within each phyletic group but differed between the clades, defining clear organizational subtypes, with each subtype composed of 4-8 genes. Of the 14 genes, only brxC/pglY and pglZ recurred in all system subtypes, with the additional genes being subtype-specific.

The present inventors termed this overall system as 'BREX' (Bacteriophage Exclusion, previously termed PYZA), and defined six major BREX types according to the phylogeny and operon organization (FIG. 1A). Thus, overall 135 BREX systems were found in 9% (126/1447) of all genomes analyzed, usually appearing on the chromosomal DNA (Tables 2-8 above). BREX type 1, the most common form of BREX, appeared 79 times in 75 genomes (Table 8 below), and is typically composed of 6 genes arranged in a conserved order (FIG. 1A).

Taken together pan genomic analysis revealed a novel broadly distributed multi-gene system which the present inventors denoted BREX system. This family of systems exists in almost 10% of sequenced microbial genomes, and can be divided into six coherent subtypes in which the gene composition and order is conserved (for further details see Example 2 below). Each BREX subtype contains 4-8 genes. By definition, all BREX subtypes contain a pglZ-domain gene. In addition, all of them harbor a large protein with a P-loop motif. The P-loop motif (GXXXXGK[T/S]) is a conserved ATP/GTP binding motif that is ubiquitously found in many ATP-utilizing proteins such as kinases, helicases, motor proteins and proteins with multiple other functions [Thomsen and Berger Molecular microbiology (2008) 69: 1071-1090]. In general, the P-loop containing genes in the various BREX subtypes share little homology: for example, the brxC gene of BREX type 1 and pglY gene of BREX type 2 share homology only across 4% of their protein sequence, and this homology is concentrated around the P-loop motif (FIG. 2). Despite the low homology, distant homology analysis with HHpred [Soding Bioinformatics (2005) 21: 951-960] showed that they share a domain denoted DUF499 (Table 1). It is therefore suggested that the P-loop containing genes in all six BREX subtypes share a similar role in the system, and hence these genes are denoted herein as brxC/pglY and referred to as having a common function (Table 1). Apart from the two core genes pglZ and brxC|pglY that appear in each of the six BREX subtypes, the remaining genes are subtype-specific or restricted to only a subset of the BREX subtypes.

TABLE 1

Genes composing the BREX systems

| Gene | Subsystems in which gene appears | Associated domains | Domain annotation | Median gene size (aa) |
|---|---|---|---|---|
| pglZ | Core gene | pfam08665 | Alkaline phosphatase | 835 |
| brxC/ pglY | Core gene | DUF499, DUF2791 (pfam10923) | ATP binding | 1208 |
| brxA | 1, 3, 5, 6 | DUF1819 (pfam08849) | Unknown function | 232 |
| pglX | 1, 2, 5, 6 | Pfam13659 (COG1002/COG0286) | Adenine-specific methylase | 1175 |

TABLE 1-continued

Genes composing the BREX systems

| Gene | Subsystems in which gene appears | Associated domains | Domain annotation | Median gene size (aa) |
|---|---|---|---|---|
| brxL | 1, 4 | COG4930 | Lon-like protease | 682 |
| brxHII | 3, 5 | COG0553 | DNA/RNA helicases | 965 |
| brxHI | 2, 6 | COG1201 | Lhr-like Helicase | 712 |
| brxD | 2, 6 | DUF2791 (pfam10923) | ATP binding | 442 |
| brxE | 6 | | Unknown function | 201 |
| brxB | 1, 5, 6 | DUF1788 (pfam08747) | Unknown function | 193 |
| pglXI | 3 | COG0863/COG1743 (pfam01555) | Adenine-specific methylase | 920 |
| brxF | 3 | | ATPase | 158 |
| pglW | 2 | COG0515 | Serine/threonine protein kinase | 1413 |
| brxP | 4 | COG0175 (pfam01507), pfam13182 | Phosphoadenosine phosphosulfate, reductase | 774 |

Example 2

Characterization of the Six BREX Types

Six types of BREX system were characterized based on manual observation of phyletic clusters in the pglZ tree (FIGS. 1A-B and Tables 2-8 above).

Type 1 BREX—

The most common BREX system identified comprises a 6-gene cluster arranged in a highly conserved order in a diverse array of bacteria and archaea (FIG. 1A-C and Table 2 above). Two of the six genes found in this conserved cluster share homology with genes from the previously reported Pgl system[11]: pglZ, coding for a protein with a predicted alkaline phosphatase domain, and pglX, coding for a protein with a putative methylase domain. The four additional genes include (i) a lon-like protease-domain gene, denoted herein as brxL; (ii) a gene, denoted herein as brxA; (iii) a gene, denoted herein as brxB; and (iv) a large, ~1200 amino acid protein with an ATP binding motif (GXXXXGK [T/S]), denoted herein as brxC. Although this does not resemble any classical combination of genes currently known to be involved in phage defense, the preferential localization of this conserved gene cluster in the genomic vicinity of other defense genes suggests that it could form a novel phage defense system.

The brxA family of proteins are, on average, 232 amino acids long and do not share sequence similarity with any domain of known function. However, as part of the protein structure initiative the structure of the type 1 brxA protein from *Magnetospirillum* sp. SO-1 was solved (PDB entry 3BHW). A significant structural similarity, spanning 44 amino acids of the brxA protein, was found between the *Magnetospirillum* brxA and the 148 amino acids RNA binding protein NusB (PDB entry 3R2C)[Stagno et al. Nucleic acids research (2011) 39, 7803-7815]. NusB is part of an anti-termination complex that enables proper ribosomal RNA transcription in *E. coli*. The anti-termination complex is initiated by binding of NusB and NusE to a BOXA site, a specific sequence on the nascent rRNA. The complex, which assembles additional proteins such as NusE, NusG and NusA, modifies RNA polymerase to enable readthrough past Rho-dependent transcriptional terminators that are present in the rRNA sequence [Luttgen et al. Journal of molecular biology (2002) 316, 875-885]. NusB was also shown to be essential for the life cycle of bacteriophage λ, and specifically for the transition from early transcription into late transcription. In the middle stages of infection, the phage N protein couples with NusB. NusE, NusA and NusG to direct the host RNA polymerase to read through the terminators of the phage immediate early genes and proceed to transcription of middle genes [Stagno et al. Nucleic acids research (2011) 39, 7803-7815]. As demonstrated in FIG. 3, the brxA protein displays significant structural homology to NusB. This similarity spans the RNA-binding interface, as well as part of the protein:protein interaction interface with NusE. In light of this similarity, it is proposed that brxA is also an RNA binding protein. It is further speculated that this protein has a role in interfering with the phage infection cycle by disrupting anti-termination events essential for the phage cycle.

Type 2 BREX—

Type 2 BREX system encloses the phage defense system originally described as PGL[10] (FIGS. 1A-B and Table 6 above). However, while the described PGL system composed four genes (pglW, X, Y and Z)[11], in 89% of the cases (16/18 instances) two additional genes, denoted herein as brxD and brxHI, were found to be associated with the system. Given that both these genes appear in the same order in the type 6 BREX system (FIG. 1A), it is suggested that these genes play an integral part of the type 2 system. The first gene, brxD, encodes a small protein predicted to bind ATP, while the second gene, brxHI encodes a predicted helicase. In addition, the serine-threonine kinase (pglW) exists exclusively in this subtype.

Type 3 BREX—

The type 3 BREX system was observed in 20 of the genomes analyzed (FIGS. 1A-B and Table 5 above). Both systems type 1 and type 3 contain the short protein denoted herein as brxA, which has no known function. In addition, both type 1 and type 3 systems contain a gene encoding an adenine-specific DNA methylase (pglX and pglXI for subtypes 1 and 3, respectively), although the methylase domain differs between the subtypes (pfam13659 and pfam01555 in pglX and pglXI, respectively). It is therefore likely that pglX and pglxXI perform the same DNA methylation function although they do not share sequence homology. BREX type 3 systems contain a predicted helicase (denoted herein as brxHII) instead of the lon-like protease present in type 1. In addition, the brxB gene present in type 1 has been replaced with another protein, denoted herein as brxF.

Type 4 BREX—

The type 4 BREX is composed of four genes (FIGS. 1A-B and Table 7 above), two of which are the core brxC/pglY and pglZ genes, and the third is the lon-like protease (denoted herein as brxL). The fourth gene, denoted herein as brxP, is subtype-specific and contains a phosphoadenylyl-sulfate reductase domain (COG0175/pfam01507). This domain was previously associated with the phage-resistance DND system that performs sulfur modifications on the DNA backbone, providing an additional link between BREX systems and phage resistance[16-18].

Type 5 BREX and Type 6 BREX—

The two least common BREX subtypes, type 5 and type 6, are similar to the type 1 BREX system but contain some additional variations (FIGS. 1A-B and Tables 3 and 4 above). In type 5 BREX, the lon-like protease present in type 1 BREX has been replaced by a helicase-domain gene (denoted herein as brxHII) carrying a COG0553 domain, and brxC/pglY has been duplicated (FIG. 1A and Table 3 above). In subfamily 6, the protease present in type 1 has been replaced by two genes, a helicase with a COG1201 domain (brxHI), and an ATP/GTP binding protein (brxD) (FIG. 1A and Table 4 above); a pair which also appears in type 2 BREX. Type 6 BREX systems also contain an additional gene found as the first gene in the cluster, which was denoted herein as brxE.

Taken together, 135 of the 144 (94%) pglZ genes detected in microbial genomes were found to be embedded as part of one of the six BREX systems described (Table 8 above), and 7 of the remaining pglZ genes were clearly part of degraded (probably pseudogenized) systems. In most cases a single BREX system per organism was found, with only 8 (6.5%) of genomes harboring more than one subtype (Table 8 above). In addition, in 14% (19/135) of the identified systems, one of the genes was either missing or has become a pseudogene (tables 2-7 above), possibly representing inactivated systems. A similar tendency for gene loss was observed for the CRISPR-Cas system, and it was suggested that CRISPR-Cas inactivation is caused by fitness cost imposed by this defense system[2,19,20]. Phage defense systems often encode toxic genes[21], and it is possible that such toxic genes encoded by BREX systems impose fitness cost and lead to gene loss in the absence of phage pressure.

Example 3

Type 1 BREX Confers Resistance to Phage Infection in *Bacillus Subtilis*

To determine whether the BREX system provides protection against phage infection, the complete type 1 BREX system from *Bacillus cereus* H3081.97 (FIG. 4A), composing the brxA, brxB, brxC, pglX, pglZ, and brxL genes was integrated into a *Bacillus subtilis* strain lacking an endogenous BREX system. The type 1 BREX system was integrated into the *Bacillus subtilis* BEST7003 genome, a derivative of *Bacillus subtilis* 168 that lacks the SPβ lysogenic phage, avoiding the potential for superinfection exclusion. Proper integration of the intact system was verified by PCR and complete genome sequencing. RNA-sequencing further verified that the genes of the integrated system are transcribed in *Bacillus subtilis* when grown in exponential phase in rich medium. Furthermore, using 5' and 3' RACE it was determined that the system is transcribed as two operons with the first four genes, brxA-brxB-brxC-pglX, forming a single transcriptional unit, while the last two genes, pglZ-brxL, are co-expressed as a second transcriptional unit (FIG. 4B). The observation that the genes in the putative BREX system are co-transcribed as two long polycistronic mRNAs further supports they work together as components of a functional system.

Ten *Bacillus subtilis* phages were selected for phage infection experiments, spanning a wide range of phage phylogeny, from T4-like Myoviridae (SPO1 and SP82G), lambda-like Siphoviridae (ϕ105, rho10, rho14 and SPO2) and SPβ-like Siphoviridae (Φ3T, SPβ, SP16 and Zeta). Two of the phages are obligatory lytic (SPO1 and SP82G), while the remaining are temperate (See Table 9 below). The sensitivity of *Bacillus subtilis* strains either lacking or containing the BREX type 1 system to infection by the different phages was evaluated using both optical density measurements in a 96-well plate format, and double agar overlay and plaque assays (Table 9 below).

Figure 4M:
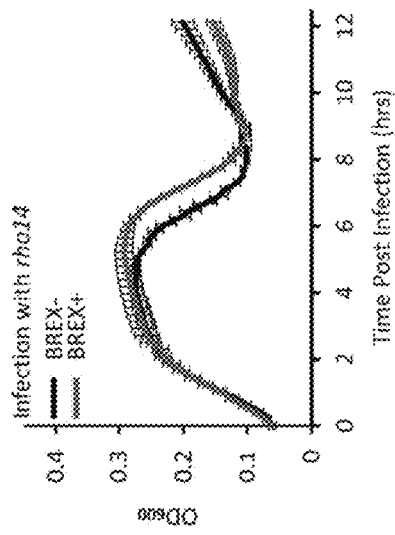

Upon phage infection, the *Bacillus subtilis* strain containing the BREX system showed complete resistance to five of the eight temperate phages tested (FIGS. 4D, I-L and Table 9 below). Growth curves of BREX-containing bacteria infected with these phages were indistinguishable from the uninfected bacteria, while rapid declines in optical density measurements were observed for the control strain lacking the BREX system, indicating lysis of the infected cells (FIGS. 4D, I-L). These results confirm that BREX is a phage defense system that provides protection against a wide array of phages, both virulent and temperate ones. In contrast, phage resistance was not observed upon infection with phage Φ105 and its close relatives, rho10 and rho14. Similar kinetics of cell lysis was observed for strains either containing or lacking the BREX system (FIGS. 4E, 4H and 4M and Table 9 below). Considering that phage Φ105 is estimated to share high (83-97%) genome homology with rho10 and rho14[14], the inability of the type 1 BREX system to protect against these three phages could indicate that this phage family has evolved strategies to counteract the BREX defense, as has been observed with other bacterial defense systems[15].

To further evaluate the level of protection provided by the type 1 BREX system against the tested temperate phages, plaque assays using increasing dilutions of phage were performed. For five of the temperate phages, no plaques were observed when the type 1 BREX-containing strain was challenged even with the highest phage concentrations, indicating that the type 1BREX system provides at least a $10^5$ fold protection against cell lysis upon phage infection (Table 9 below). The plaque assays also confirmed that phage Φ105 and its relatives evade type 1 BREX defense, with similar efficiencies of plating and plaque morphology observed in both type 1 BREX-containing and wild-type control strains (Table 9 below).

TABLE 9

Type 1 BREX protection against phage infection

| Phage | Genus | Family | Life cycle | Infection blocked by BREX? | Efficiency of BREX protection[a] |
|---|---|---|---|---|---|
| SPβ | SPβ-like | Siphoviridae | Temperate | Yes | >$10^5$ |
| SP16 | SPβ-like | Siphoviridae | Temperate | Yes | >$10^5$ |
| Zeta | SPβ-like | Siphoviridae | Temperate | Yes | >$10^5$ |
| Φ3T | SPβ-like | Siphoviridae | Temperate | Yes | >$10^5$ |

TABLE 9-continued

Type 1 BREX protection against phage infection

| Phage | Genus | Family | Life cycle | Infection blocked by BREX? | Efficiency of BREX protection[a] |
|---|---|---|---|---|---|
| SPO2 | Lambda-like | Siphoviridae | Temperate | Yes | >$10^5$ |
| Φ105 | Lambda-like | Siphoviridae | Temperate | No | 1 |
| rho10 | Lambda-like | Siphoviridae | Temperate | No | 1 |
| rho14 | Lambda-like | Siphoviridae | Temperate | No | 1 |
| SPO1 | SPO1-like | Myoviridae | Obligatory lytic | Yes | $8 * 10^2 \pm 0.02$ |
| SP82G | SPO1-like | Myoviridae | Obligatory lytic | Yes | $1.8 * 10^1 \pm 0.08$ |

[a]Protection efficiency was calculated as the ratio between the number of plaques formed on the BREX-lacking strain divided by the number of plaques formed on the BREX-containing strain with the same phage titer, using increasing titers. Standard deviation was calculated from a biological triplicate of the plaque experiment.

The type 1 BREX-containing *Bacillus subtilis* strain also displayed some protection from the lytic SPO1 and SP82G phages in liquid culture experiments. Growth curves of the strain containing the BREX type 1 system infected with either SPO1 or SP28G phages were similar to the uninfected strains when evaluated for up to 12 hours following infection, while complete lysis was observed in infected control strains lacking the BREX system (FIGS. 4F-G). Endpoint analysis using plaque assays revealed a $10^1$ fold reduction in plaque numbers in type 1 BREX-containing strains for SPO1 and SP82G phages (Table 9 above). In addition, plaque sizes were reduced 1.5-2 fold in the type 1 BREX-containing strain, to 47% and 65% the diameter of those observed in the control strain lacking the type 1 BREX system for SPO1 and SP82G, respectively (data not shown). These results are consistent with the observation that incubation of the type 1 BREX-containing strain with the two lytic phages for extended periods of time (>20 hours) often resulted in an eventual culture decline occurring at apparently stochastic points in time (FIGS. 5A-B).

To gain further insight into the nature of the incomplete type 1 BREX defense against these lytic phages, a one-step phage growth curve assay [Carlson Bacteriophages, Biology and Applications (eds. E Kutter, A Sulakvelidze) (2005) pp. 437-494. CRC Press, Florida.] was performed with SPO1. Briefly, this experiment involves mixing SPO1-infected cells with a SPO1-sensitive *B. subtilis* cells and plating them together using an agar overlay method. Phage bursts from successful infections are visualized as a single plaque on a lawn from the SPO1-sensitive *B. subtilis* strain, enabling an evaluation of the number of phages that have adsorbed and completed a successful infection cycle. As demonstrated in FIG. 6, enumeration of plaques during the first 45 minutes of the time course infection indicated that the SPO1 phage was able to complete the lytic cycle only in 9%±4 of the initially infected cells (FIG. 6). A delay in kinetics of the phage cycle was also observed, with phage bursts observed 75 minutes and 105 minutes following infection of BREX-lacking and type 1 BREX-containing cells, respectively (FIG. 6).

Taken together, these results suggest that the type 1 BREX system provides significant protection from infection by the lytic phages SPO1 and SP82G.

Example 4

The Mechanism of Action of Type 1 BREX

Due to the homology of a subset of the genes in the BREX system to genes in the previously described Pgl system[10], it was necessary to examine whether BREX also functions through the described Pgl mechanism. The Pgl phenotype observed in *S. coelicolor* A3 predicts that the Pgl system does not confer resistance to phage first cycle of infection. One-step phage growth curve assays were used to examine the first infection cycle of phage Φ3T in type 1 BREX-containing cells. As demonstrated in FIG. 7, while the control strains lacking the BREX system displayed phage burst sizes of 61.5±10.2 particles per infected cell, there was no production of Φ3T phage during infections of type 1 BREX-containing *Bacillus subtilis* strains under similar conditions. To exclude the possibility that productive phage infection could occur at later time points, experiments were extended to 120 minutes (corresponds to 3 infection cycles in control strains) in type 1 BREX-containing *Bacillus subtilis* strains. As shown in FIG. 7, plaques were not observed in the type 1 BREX-containing *Bacillus subtilis* strains even at later time points. These results demonstrate that unlike the *S. coelicolor* Pgl system, the type 1 BREX system confers resistance to phage first cycle of infection.

Previous experiments with the *S. coelicolor* Pgl system also demonstrated that although the Pgl defense system prevents continued propagation of the temperate phage ΦC31, it does not block lysogeny of the phage[10]. To determine whether BREX also permits lysogeny, phage Φ3T integration into the *Bacillus subtilis* genome during infection was examined using a PCR assay. In control *Bacillus subtilis* strains lacking BREX, lysogeny was first detected 10 minutes following phage infection (FIG. 8). However, no evidence for phage integration into the host genome was found in type 1 BREX-containing *Bacillus subtilis* strains. Evaluation of lysogeny in bacterial colonies that survived the phage infection also indicated that none of the surviving type 1 BREX-containing colonies were lysogens, while all surviving colonies tested in strains lacking the BREX system were lysogenic for phage Φ3T.

One of the common forms of phage defense is abortive infection (Abi), where infected cells commit "suicide" before phage progeny are produced, thus protecting the culture from phage propagation[4]. To test whether the type 1 BREX system acts via an Abi mechanism, the type 1 BREX-containing *Bacillus subtilis* strains were infected with increasing concentrations of Φ3T phage. Using high multiplicity of infection (MOI) where nearly all bacteria are infected in the first cycle, massive cell lysis should be observed in the culture in the case of Abi. The results demonstrated that even at an MOI>1, no significant growth arrest or culture decline was found in the liquid culture (FIG. 9), suggesting that the type 1 BREX is not an Abi system.

In the next step, BREX ability to prevent phage adsorption and phage DNA replication were evaluated. As illustrated in FIG. 10, adsorption assays showed that Φ3T efficiently adsorbs to both type 1 BREX-containing and BREX-lacking *Bacillus subtilis* strains, indicating that type 1 BREX does not block adsorption. In order to test phage DNA replication within infected cells, total cellular DNA (including chromosomal DNA and intracellular phage DNA) was extracted at successive time points following a high-MOI infection by Φ3T; and the extracted DNA was sequenced by Illumina sequencing. Since host DNA is not degraded following Φ3T infection (FIG. 18), mapping sequenced reads to the reference *Bacillus subtilis* and Φ3T genomes, allowed quantification of the number of Φ3T genome equivalents per infected cell was quantified at each time point. In control *Bacillus subtilis* strains lacking BREX, phage DNA replication began between 10 and 15 minutes following infection, and 30 minutes following infection, phage DNA levels were elevated 81-fold relative to that observed at the 10 minutes time point (FIG. 11). In contrast, no increase in phage DNA levels was observed in type 1 BREX-containing *Bacillus subtilis* strains (FIG. 11).

To further test whether BREX leads to cleavage or degradation of phage DNA, the integrity of phage DNA was examined using Southern blot analysis on total cellular DNA extracted from phage-infected cells at increasing time points following infection. This analysis showed extensive replication of phage DNA in control *Bacillus subtilis* strains lacking type 1 BREX and affirmed no phage DNA replication in *Bacillus subtilis* strains containing type 1 BREX (FIG. 12). However, as shown in FIG. 12, the phage DNA in type 1 BREX-containing *Bacillus subtilis* strains appeared intact with no signs of phage DNA cleavage or processive degradation.

These results indicate that phage DNA replication does not occur in type 1 BREX-containing cells, that type 1 BREX does not lead to the degradation of phage DNA and that this system exerts its function at the early stages of the infection cycle.

As type 1 BREX contain an m6A DNA adenine methylase (pglX), the present inventors have evaluated whether either bacterial or phage DNA are methylated in a BREX-dependent manner. To this end, the PacBio sequencing platform that directly detects m6A modifications in sequenced DNA [Murray et al. Nucleic acids research (2012) 40: 11450-11462] was used. As demonstrated in FIG. 13A, the PacBio platform clearly detected m6A methylation on the 5$^{th}$ position of the non-palindromic hexamer TAGGAG in chromosomal DNA extracted from type 1 BREX-containing *Bacillus subtilis* strains. Thus, while nearly all TAGGAG motifs were methylated in type 1 BREX-containing *Bacillus subtilis* strains (FIG. 13B), no methylation on this motif was observed in the control *Bacillus subtilis* strains lacking the BREX system. These results indicate that type 1 BREX drives motif-specific methylation on the genomic DNA of the bacteria in which it resides.

To examine whether BREX also methylates the invading phage DNA, total cellular DNA (including chromosomal DNA and intracellular phage DNA) was extracted at 10 and 15 minutes following a high-MOI infection by Φ3T and analysed PacBio sequencing. The results affirmed that the TAGGAG motifs in the bacterial genome were methylated throughout the infection. However, there was no methylation on these motifs in the phage genome at the time points tested during infection (data not shown).

The presence of bacterial-specific methylation could suggest that the type 1 BREX system encodes some kind of restriction/modification activity, and that the methylation of TAGGAG motifs in the bacterial genome may serve to differentiate between self and non-self DNA. This suggests that deletion of the methylase gene, pglX, would be detrimental to the cell, as the genomic TAGGAG motifs will no longer be protected from the putative restriction activity of BREX. However, as can be seen in FIG. 14A, deletion of the pglX from the type 1 BREX system that was integrated into *Bacillus subtilis* was not toxic to the cells. Moreover, type 1 BREX-containing *Bacillus subtilis* strains having a deletion of pglX were sensitive to all phage tested (for example FIG. 14B demonstrating strain sensitivity to Φ3T). These results show that pglX is essential for type 1 BREX-mediated phage resistance, and also suggest that the BREX mechanism of action is not consistent with a simple restriction/modification activity.

Taken together, these results suggest that phage adsorption occurs in type 1 BREX-containing strains. This system does not display the Pgl phenotype, and hence probably functions through a novel mechanism different than that of the Pgl system. In addition, the system methylates the host chromosomal DNA at a specific motif, and that this methylation is likely to be essential for the system's activity.

Example 5

Extensive Horizontal Transfer of BREX Systems

An examination of the distribution of BREX systems across microbial species showed that these systems undergo extensive horizontal transfer (FIG. 15). First, the distribution of systems across the species tree is interrupted (resembling the way CRISPRs are distributed in bacterial and archaeal genomes[22]). Second, the pglZ tree is not consistent with the species tree, and closely related species can accommodate distantly related pglZ and vice versa. Nevertheless, phylogenetic trees reconstructed from additional BREX genes generally recapitulate the structure of the pglZ tree, suggesting that genes within specific BREX systems co-evolve and are co-horizontally transferred (For example FIG. 16).

The individual clades demonstrated in FIG. 1A separate close to the root of the PglZ tree and the six defined BREX subtypes are widespread across the entire bacterial and archaeal tree of life (FIG. 15), thus suggesting that the separation between the systems occurred at an ancient point in the evolutionary history of bacteria and archaea. The relative abundance of BREX type 1, and its appearance on several clades on the pglZ tree (FIG. 1A), suggest that this subtype might be the ancestral form of BREX. Despite the extensive horizontal transfer observed for the BREX systems, some clades show enrichment in specific subtypes: subtype 1 is enriched in Deltaproteobacteria (p=0.001); subtype 2 (the PGL system) appears almost solely in Actinobacteria (p=4.8×10$^{-9}$); and subtype 5 is exclusive to the archaeal class Halobacteria. The enrichment of specific subtypes within specific phyla might link the ancestry of these subtypes to the phyla in which they are enriched; alternatively, phylum-specific BREX subtypes might rely on additional, phylum-specific cellular mechanisms that are not directly encoded in the BREX genes, or provide defense against phages that predominantly attack the specific phyla.

Within the 1447 genomes, the relative frequency of BREX in archaea (10%) was similar to that observed in bacteria (8.5%). Only subtypes 1, 3 and 5 were represented in the 111 archaeal genomes analyzed by the present inventors. However, the absence of subtypes 2, 4 and 6 from archaeal genomes could be the result of their rarity and the relative paucity of sequenced archaeal genomes, comprising only 111 out of the 1447 genomes analyzed.

Taken together, the BREX systems undergo extensive horizontal transfer, with subtype 1 possibly the ancestral form of BREX.

Example 6

Frequent Interruptions in the Adenine-Specific Methylase PglX

One of the type 1 BREX-containing *Bacillus subtilis* strains obtained was not active against any of the tested phages although PCR analysis showed that it contained the complete BREX system. Upon Illumina whole-genome re-sequencing of the engineered strain, a frameshift mutation in the adenine-specific methylase gene pglX was observed, resulting from a single nucleotide deletion occurring in a stretch of seven guanine (G) residues at position 2128 (out of 3539 bp) of this gene. These results further support that the pglX gene is essential for the function of the type 1 BREX system. Therefore more broadly additional evidence for genetic variability of pglX in nature was examined.

In 11% (15/135) of the BREX systems that were documented, the pglX gene presented irregularities with respect to the common BREX organization (FIG. 17A). These included seven instances of premature stop codons in the middle of the gene, two instances of gene duplication and six occurrences where a full length pglX gene was adjacent to one or more partial forms of pglX (with an extreme example in *Methacobrevibacter smithii*, where five truncated forms of the pglX are found near the full length gene (FIG. 17B). The complete and truncated forms of the methylase usually resided on opposite strands and were accompanied by a gene annotated as a recombinase, possibly involved in switching between the two versions of pglX. Indeed, when analyzing the genomes of two strains of *Lactobacillus rhamnosus* GG that were sequenced independently (NCBI accessions FM179322 (NC_013198 SEQ ID NO: 1) and AP011548 (NC_017482 SEQ ID NO: 2), the present inventors found that the pglX sequence was identical between the strains except for a cassette of 313 bp that was switched between the full length and truncated pglX genes (FIG. 17C). The interchanged cassette was flanked by two inverted repeats suggesting a recombination-based cassette switching possibly mediated by the accompanying recombinase.

DNA shuffling via recombination events was previously shown to control phase variation in bacterial defense-related genes to alter the specificity or to mitigate toxic effects of specific genes in the absence of phage pressure[4-26]. Taken together, since no other gene except for pglX presented such high rates of irregularities, these results marked pglX as possibly undergoing frequent phase-variation, suggesting that this gene might confer specificity in the BREX system, or, alternatively, is particularly toxic.

Example 7

Extensive Identification of BREX Systems in Prokaryotic Genomes

Following the initial homology searches in 1447 genomes described in details hereinabove, the present inventors performed an extensive homology search on a bigger set of genomes, 2263 complete and 5493 draft genomes, using the 14 genes associated with BREX systems (Table 1 above). Only gene clusters containing the two core genes (pglX and brxC/pglY) and at least two additional genes were considered (Tables 10-16 above).

The homology searches of the BREX genes in the 5493 genomes found 536 BREX systems in 9.3% (513/5493) of all genomes analyzed.

BREX type 1, the most common form of BREX, appeared 409 times in 398 genomes (Tables 10 and 16 above).

In most cases a single BREX system per organism was found, with only 21 (4%) of genomes harboring more than one subtype (Table 16 above).

In addition, in 25% (134/536) of the identified systems, one of the genes was either missing or has become a pseudogene (Tables 10-15 above), possibly representing inactivated systems.

Furthermore, in 11.5% (62/536) of the BREX systems that were documented, the pglX gene presented irregularities with respect to the common BREX organization.

Taken together, the broader analysis of the 7756 genomes reinforced all findings obtained with the 1447 set of genomes described hereinabove.

Taken together, the above results described a phage resistance system widespread in bacteria and archaea, which the present inventors denoted BREX system. The BREX family of systems can be divided into six coherent subtypes containing 4-8 genes each, two of which are core genes, pglZ and brxC/pglY, present in all systems. The results also suggested pglX might confer specificity in the BREX system, or, alternatively, is particularly toxic. Moreover, the BREX systems undergo extensive horizontal transfer, with subtype 1, the most frequent subtype of this system, possibly the ancestral form of BREX.

In addition, the results demonstrated that the BREX type 1 system confers complete or partial resistance against phages spanning a wide phylogeny of phage types, including lytic and temperate phages, even in the first cycle of infection. The abundance of this system and the efficiency in which it protects against phages implies that it plays an important role as a major line of defense encoded by bacteria against phages.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

TABLE 17

SEQ ID NO. vs. Accession Number Index

| SEQ ID NO. | Accession No. |
|---|---|
| 3 | 643625571 |
| 4 | 640726035 |
| 5 | 640526647 |
| 6 | 643706992 |
| 7 | 649671139 |
| 8 | 378443454 |
| 9 | 644886774 |
| 10 | 438000910 |
| 11 | 2506688719 |
| 12 | 2506688721 |
| 13 | 643706994 |
| 14 | 326402148 |
| 15 | 344198243 |
| 16 | 169786889 |
| 17 | 407698262 |

TABLE 17-continued

SEQ ID NO. vs. Accession Number Index

| SEQ ID NO. | Accession No. |
|---|---|
| 18 | 86156430 |
| 19 | 56475432 |
| 20 | 146351220 |
| 21 | 374998023 |
| 22 | 386866198 |
| 23 | 410470815 |
| 24 | 323524377 |
| 25 | 330814956 |
| 26 | 134294128 |
| 27 | 313671969 |
| 28 | 78042616 |
| 29 | 189499000 |
| 30 | 374294493 |
| 31 | 374294493 |
| 32 | 300853232 |
| 33 | 302384444 |
| 34 | 302384444 |
| 35 | 339441064 |
| 36 | 339324158 |
| 37 | 257057919 |
| 38 | 270307451 |
| 39 | 300087139 |
| 40 | 89892746 |
| 41 | 408417460 |
| 42 | 256827818 |
| 43 | 402570638 |
| 44 | 239904639 |
| 45 | 46562128 |
| 46 | 387151873 |
| 47 | 297567992 |
| 48 | 401761514 |
| 49 | 385785459 |
| 50 | 387869382 |
| 51 | 259906682 |
| 52 | 85372828 |
| 53 | 386632422 |
| 54 | 386627502 |
| 55 | 157159467 |
| 56 | 260866153 |
| 57 | 218561636 |
| 58 | 172056045 |
| 59 | 347534971 |
| 60 | 302877245 |
| 61 | 302877245 |
| 62 | 239825584 |
| 63 | 400756305 |
| 64 | 332661890 |
| 65 | 386712343 |
| 66 | 435852812 |
| 67 | 397655102 |
| 68 | 385816611 |
| 69 | 301065125 |
| 70 | 385812838 |
| 71 | 403514032 |
| 72 | 268318562 |
| 73 | 338202359 |
| 74 | 385826720 |
| 75 | 258506995 |
| 76 | 296110131 |
| 77 | 148642060 |
| 78 | 397779166 |
| 79 | 409187964 |
| 80 | 435850242 |
| 81 | 20088899 |
| 82 | 21226102 |
| 83 | 88601322 |
| 84 | 88601322 |
| 85 | 336115651 |
| 86 | 83588874 |
| 87 | 304319677 |
| 88 | 403056439 |
| 89 | 118578449 |
| 90 | 194335182 |
| 91 | 91790731 |
| 92 | 330806657 |
| 93 | 392419087 |
| 94 | 93004831 |
| 95 | 226303489 |
| 96 | 192288433 |
| 97 | 90019649 |
| 98 | 378448274 |
| 99 | 383494824 |
| 100 | 16763390 |
| 101 | 378697983 |
| 102 | 379699217 |
| 103 | 378982542 |
| 104 | 378987404 |
| 105 | 330837866 |
| 106 | 117918459 |
| 107 | 113968346 |
| 108 | 257062754 |
| 109 | 284034943 |
| 110 | 313681130 |
| 111 | 427711179 |
| 112 | 114565576 |
| 113 | 114565576 |
| 114 | 85857845 |
| 115 | 438000910 |
| 116 | 332798023 |
| 117 | 237653092 |
| 118 | 409131816 |
| 119 | 304315537 |
| 120 | 390948458 |
| 121 | 431932943 |
| 122 | 229606122 |
| 123 | 360034408 |
| 124 | 260752245 |
| 125 | 83309099 |
| 126 | 83309099 |
| 127 | 120552944 |
| 128 | 186680550 |
| 129 | 338209545 |
| 130 | 257051090 |
| 131 | 257051090 |
| 132 | 169237353 |
| 133 | 169237353 |
| 134 | 344209485 |
| 135 | 344209485 |
| 136 | 345006827 |
| 137 | 345006827 |
| 138 | 433593057 |
| 139 | 433593057 |
| 140 | 296120274 |
| 141 | 220915123 |
| 142 | 262193326 |
| 143 | 262193326 |
| 144 | 302390797 |
| 145 | 117927211 |
| 146 | 392406391 |
| 147 | 150002608 |
| 148 | 312792283 |
| 149 | 219846956 |
| 150 | 317151727 |
| 151 | 146328629 |
| 152 | 289191496 |
| 153 | 289191496 |
| 154 | 336475959 |
| 155 | 189218017 |
| 156 | 83588874 |
| 157 | 77163561 |
| 158 | 300112745 |
| 159 | 154250456 |
| 160 | 154250456 |
| 161 | 325106586 |
| 162 | 297616214 |
| 163 | 297616214 |
| 164 | 332798023 |
| 165 | 269791619 |
| 166 | 320114857 |
| 167 | 289577265 |

TABLE 17-continued

SEQ ID NO. vs. Accession Number Index

| SEQ ID NO. | Accession No. |
|---|---|
| 168 | 167036431 |
| 169 | 390933132 |
| 170 | 433653743 |
| 171 | 333895862 |
| 172 | 83718394 |
| 173 | 257091663 |
| 174 | 383452024 |
| 175 | 383452024 |
| 176 | 340792956 |
| 177 | 86738724 |
| 178 | 312193897 |
| 179 | 262193326 |
| 180 | 262193326 |
| 181 | 336115651 |
| 182 | 302864508 |
| 183 | 145220606 |
| 184 | 379706264 |
| 185 | 121582711 |
| 186 | 257054089 |
| 187 | 134096620 |
| 188 | 433601838 |
| 189 | 430741030 |
| 190 | 162448269 |
| 191 | 32141095 |
| 192 | 182433793 |
| 193 | 72160406 |
| 194 | 296267998 |
| 195 | 83642913 |
| 196 | 432327926 |
| 197 | 392406391 |
| 198 | 169830219 |
| 199 | 206895078 |
| 200 | 428771848 |
| 201 | 428771848 |
| 202 | 291285947 |
| 203 | 431792069 |
| 204 | 253698656 |
| 205 | 327312315 |
| 206 | 148269145 |
| 207 | 325106586 |
| 208 | 83718394 |
| 209 | 257091663 |
| 210 | 383452024 |
| 211 | 340792956 |
| 212 | 86738724 |
| 213 | 312193897 |
| 214 | 262193326 |
| 215 | 336115651 |
| 216 | 302864508 |
| 217 | 145220606 |
| 218 | 379706264 |
| 219 | 121582711 |
| 220 | 257054089 |
| 221 | 134096620 |
| 222 | 433601838 |
| 223 | 430741030 |
| 224 | 162448269 |
| 225 | 162448269 |
| 226 | 162448269 |
| 227 | 32141095 |
| 228 | 182433793 |
| 229 | 72160406 |
| 230 | 296267998 |
| 231 | 83642913 |
| 232 | 396584758 |
| 233 | 452732384 |
| 234 | 472443541 |
| 235 | 336440820 |
| 236 | 476380507 |
| 237 | 374627927 |
| 238 | 424979852 |
| 239 | 472222746 |
| 240 | 419173668 |
| 241 | 331640257 |
| 242 | 375004550 |
| 243 | 421082290 |
| 244 | 417605122 |
| 245 | 332655353 |
| 246 | 373485774 |
| 247 | 417268567 |
| 248 | 363900611 |
| 249 | 419280801 |
| 250 | 262371200 |
| 251 | 256402721 |
| 252 | 262374339 |
| 253 | 418024796 |
| 254 | 472199351 |
| 255 | 419235449 |
| 256 | 352101099 |
| 257 | 226597601 |
| 258 | 455877139 |
| 259 | 407801688 |
| 260 | 424026168 |
| 261 | 443537933 |
| 262 | 329896015 |
| 263 | 433118449 |
| 264 | 313151045 |
| 265 | 470894026 |
| 266 | 420093456 |
| 267 | 443474995 |
| 268 | 423730148 |
| 269 | 452301294 |
| 270 | 452281584 |
| 271 | 320096521 |
| 272 | 373114969 |
| 273 | 421857666 |
| 274 | 422905795 |
| 275 | 421735395 |
| 276 | 293373625 |
| 277 | 424001199 |
| 278 | 410105720 |
| 279 | 301030692 |
| 280 | 319430354 |
| 281 | 472217717 |
| 282 | 423286106 |
| 283 | 425019536 |
| 284 | 238756169 |
| 285 | 398800292 |
| 286 | 433099189 |
| 287 | 452722814 |
| 288 | 419389168 |
| 289 | 242362072 |
| 290 | 422028620 |
| 291 | 442594974 |
| 292 | 407974869 |
| 293 | 476381541 |
| 294 | 452704090 |
| 295 | 452743095 |
| 296 | 425034026 |
| 297 | 254426770 |
| 298 | 424005355 |
| 299 | 418354477 |
| 300 | 450256199 |
| 301 | 223955923 |
| 302 | 419919231 |
| 303 | 452722284 |
| 304 | 449053971 |
| 305 | 386289604 |
| 306 | 359780050 |
| 307 | 411116154 |
| 308 | 224581172 |
| 309 | 314953942 |
| 310 | 452301765 |
| 311 | 422033758 |
| 312 | 422912392 |
| 313 | 296328579 |
| 314 | 294784664 |
| 315 | 262377679 |
| 316 | 418013522 |
| 317 | 476381295 |

TABLE 17-continued

SEQ ID NO. vs. Accession Number Index

| SEQ ID NO. | Accession No. |
|---|---|
| 318 | 293611286 |
| 319 | 423144195 |
| 320 | 224581037 |
| 321 | 469923807 |
| 322 | 336420422 |
| 323 | 237666990 |
| 324 | 417550237 |
| 325 | 390606126 |
| 326 | 254692771 |
| 327 | 211594571 |
| 328 | 415823418 |
| 329 | 301064104 |
| 330 | 425024171 |
| 331 | 238694717 |
| 332 | 386814329 |
| 333 | 476381563 |
| 334 | 295396063 |
| 335 | 419200062 |
| 336 | 423718272 |
| 337 | 423926641 |
| 338 | 424977968 |
| 339 | 424971161 |
| 340 | 229509077 |
| 341 | 340358330 |
| 342 | 424023365 |
| 343 | 424612424 |
| 344 | 443530314 |
| 345 | 424605785 |
| 346 | 357040530 |
| 347 | 455967306 |
| 348 | 425047878 |
| 349 | 149189552 |
| 350 | 385881638 |
| 351 | 427597607 |
| 352 | 389575461 |
| 353 | 442610050 |
| 354 | 182624174 |
| 355 | 314994688 |
| 356 | 211595724 |
| 357 | 419887425 |
| 358 | 472214599 |
| 359 | 422901577 |
| 360 | 406351917 |
| 361 | 225001047 |
| 362 | 419281346 |
| 363 | 356907979 |
| 364 | 419206516 |
| 365 | 406839856 |
| 366 | 440708760 |
| 367 | 424651801 |
| 368 | 472210693 |
| 369 | 196250231 |
| 370 | 476380904 |
| 371 | 427557910 |
| 372 | 224515124 |
| 373 | 381395491 |
| 374 | 422702452 |
| 375 | 409167416 |
| 376 | 476380862 |
| 377 | 358069018 |
| 378 | 421345543 |
| 379 | 417812631 |
| 380 | 401676751 |
| 381 | 314998443 |
| 382 | 421334477 |
| 383 | 423532168 |
| 384 | 314940712 |
| 385 | 149113251 |
| 386 | 422924875 |
| 387 | 423891867 |
| 388 | 419378419 |
| 389 | 427682108 |
| 390 | 423480222 |
| 391 | 421772441 |
| 392 | 448689403 |
| 393 | 421768382 |
| 394 | 427621994 |
| 395 | 343503287 |
| 396 | 472166833 |
| 397 | 418348058 |
| 398 | 427575979 |
| 399 | 419252283 |
| 400 | 251833313 |
| 401 | 455819031 |
| 402 | 424609621 |
| 403 | 476380950 |
| 404 | 469924283 |
| 405 | 472149938 |
| 406 | 417209278 |
| 407 | 390169096 |
| 408 | 455593728 |
| 409 | 424644158 |
| 410 | 452702507 |
| 411 | 399579771 |
| 412 | 472157757 |
| 413 | 224581092 |
| 414 | 427658715 |
| 415 | 424974911 |
| 416 | 417589425 |
| 417 | 294807000 |
| 418 | 419362951 |
| 419 | 419362951 |
| 420 | 345651578 |
| 421 | 373849145 |
| 422 | 410618100 |
| 423 | 224485776 |
| 424 | 298384183 |
| 425 | 298384183 |
| 426 | 419358064 |
| 427 | 419358064 |
| 428 | 419352509 |
| 429 | 419352509 |
| 430 | 417223690 |
| 431 | 417223690 |
| 432 | 381157709 |
| 433 | 282900768 |
| 434 | 425444918 |
| 435 | 472183758 |
| 436 | 424655749 |
| 437 | 334126448 |
| 438 | 126665966 |
| 439 | 423709466 |
| 440 | 437842748 |
| 441 | 418008622 |
| 442 | 469924241 |
| 443 | 410637153 |
| 444 | 363898451 |
| 445 | 472152144 |
| 446 | 419240736 |
| 447 | 419383938 |
| 448 | 424630728 |
| 449 | 374627936 |
| 450 | 374627936 |
| 451 | 418342894 |
| 452 | 420088308 |
| 453 | 255743719 |
| 454 | 455929923 |
| 455 | 206975561 |
| 456 | 423164021 |
| 457 | 417522340 |
| 458 | 419831962 |
| 459 | 139439021 |
| 460 | 314944229 |
| 461 | 423147095 |
| 462 | 224485442 |
| 463 | 422305960 |
| 464 | 225363921 |
| 465 | 417815500 |
| 466 | 425040990 |
| 467 | 343177620 |

TABLE 17-continued

SEQ ID NO. vs. Accession Number Index

| SEQ ID NO. | Accession No. |
|---|---|
| 468 | 423878932 |
| 469 | 211593993 |
| 470 | 418398711 |
| 471 | 378759082 |
| 472 | 402296507 |
| 473 | 259048327 |
| 474 | 455905617 |
| 475 | 224514842 |
| 476 | 357631901 |
| 477 | 384096966 |
| 478 | 425069205 |
| 479 | 265756999 |
| 480 | 427646214 |
| 481 | 403955718 |
| 482 | 373471569 |
| 483 | 456039135 |
| 484 | 224993695 |
| 485 | 149109670 |
| 486 | 365096837 |
| 487 | 298527635 |
| 488 | 395208219 |
| 489 | 458920171 |
| 490 | 419246266 |
| 491 | 423155496 |
| 492 | 421624890 |
| 493 | 427425534 |
| 494 | 458913812 |
| 495 | 417191381 |
| 496 | 424621178 |
| 497 | 262405036 |
| 498 | 422890700 |
| 499 | 419229938 |
| 500 | 424015456 |
| 501 | 335043876 |
| 502 | 419894708 |
| 503 | 472202862 |
| 504 | 211594035 |
| 505 | 424618529 |
| 506 | 224581212 |
| 507 | 169343945 |
| 508 | 405982616 |
| 509 | 469924367 |
| 510 | 417292897 |
| 511 | 418336054 |
| 512 | 423152690 |
| 513 | 419841668 |
| 514 | 421338374 |
| 515 | 325917999 |
| 516 | 365822320 |
| 517 | 294645413 |
| 518 | 294645413 |
| 519 | 419367985 |
| 520 | 419367985 |
| 521 | 419343475 |
| 522 | 419343475 |
| 523 | 365833706 |
| 524 | 365833706 |
| 525 | 448302553 |
| 526 | 448302553 |
| 527 | 448681954 |
| 528 | 448681954 |
| 529 | 448413196 |
| 530 | 448413196 |
| 531 | 470888868 |
| 532 | 443475057 |
| 533 | 386810750 |
| 534 | 196035064 |
| 535 | 419725778 |
| 536 | 336430981 |
| 537 | 242355593 |
| 538 | 397905651 |
| 539 | 390993910 |
| 540 | 323701113 |
| 541 | 288572734 |
| 542 | 325672510 |
| 543 | 408373871 |
| 544 | 423394306 |
| 545 | 254434980 |
| 546 | 334130722 |
| 547 | 472439485 |
| 548 | 398888999 |
| 549 | 196044104 |
| 550 | 374534854 |
| 551 | 415887008 |
| 552 | 343509531 |
| 553 | 381156824 |
| 554 | 374623705 |
| 555 | 326204471 |
| 556 | 326389902 |
| 557 | 256752440 |
| 558 | 256752440 |
| 559 | 211606481 |
| 560 | 384563951 |
| 561 | 453074660 |
| 562 | 375098335 |
| 563 | 359765453 |
| 564 | 451335404 |
| 565 | 126666487 |
| 566 | 257461537 |
| 567 | 440700728 |
| 568 | 163804182 |
| 569 | 458780588 |
| 570 | 383824531 |
| 571 | 224581088 |
| 572 | 383827549 |
| 573 | 365878943 |
| 574 | 254173939 |
| 575 | 149176214 |
| 576 | 458859600 |
| 577 | 441515884 |
| 578 | 163719735 |
| 579 | 381168746 |
| 580 | 211606481 |
| 581 | 288920043 |
| 582 | 452746574 |
| 583 | 319947885 |
| 584 | 2530355709 |
| 585 | [*Vibrio cholerae* O1 str. 3582-05] |
| 586 | 650306799 |
| 587 | 373108119 |
| 588 | 373108120 |
| 589 | 2520346679 |
| 590 | 384563951 |
| 591 | 453074660 |
| 592 | 375098335 |
| 593 | 359765453 |
| 594 | 451335404 |
| 595 | 126666487 |
| 596 | 257461537 |
| 597 | 440700728 |
| 598 | 163804182 |
| 599 | 458780588 |
| 600 | 383824531 |
| 601 | 224581088 |
| 602 | 383827549 |
| 603 | 365878943 |
| 604 | 254173939 |
| 605 | 149176214 |
| 606 | 458859600 |
| 607 | 441515884 |
| 608 | 163719735 |
| 609 | 381168746 |
| 610 | 211606481 |
| 611 | 211606481 |
| 612 | 288920043 |
| 613 | 452746574 |
| 614 | 643625571 |
| 615 | 640726035 |
| 616 | 640526647 |

TABLE 17-continued

SEQ ID NO. vs. Accession Number Index

| SEQ ID NO. | Accession No. |
|---|---|
| 617 | 326402593 |
| 618 | 344200467 |
| 619 | 169786942 |
| 620 | 407700180 |
| 621 | 86159654 |
| 622 | 56478399 |
| 623 | 403571624 |
| 624 | 374998147 |
| 625 | 386867049 |
| 626 | 410471296 |
| 627 | 323527069 |
| 628 | 330816348 |
| 629 | 134296119 |
| 630 | 313673973 |
| 631 | 78043274 |
| 632 | 189500610 |
| 633 | 374294726 |
| 634 | 374297213 |
| 635 | 300856435 |
| 636 | 302387137 |
| 637 | 302388015 |
| 638 | 310658340 |
| 639 | 339442903 |
| 640 | 339327420 |
| 641 | 257060038 |
| 642 | 270307693 |
| 643 | 300088703 |
| 644 | 89893422 |
| 645 | 408420313 |
| 646 | 256829113 |
| 647 | 402570961 |
| 648 | 239908251 |
| 649 | 46580432 |
| 650 | 387153155 |
| 651 | 297570109 |
| 652 | 401762042 |
| 653 | 385787389 |
| 654 | 387872412 |
| 655 | 259909432 |
| 656 | 85375773 |
| 657 | 386637212 |
| 658 | 386632292 |
| 659 | 157159791 |
| 660 | 260871024 |
| 661 | 218561659 |
| 662 | 172056357 |
| 663 | 347535921 |
| 664 | 302878116 |
| 665 | 302878741 |
| 666 | 239826789 |
| 667 | 39997206 |
| 668 | 332661908 |
| 669 | 386716367 |
| 670 | 435853826 |
| 671 | 397655646 |
| 672 | 385817606 |
| 673 | 301067094 |
| 674 | 385813807 |
| 675 | 403515035 |
| 676 | 268319508 |
| 677 | 338203660 |
| 678 | 385828737 |
| 679 | 258509093 |
| 680 | 296110179 |
| 681 | 148643811 |
| 682 | 397780111 |
| 683 | 410669357 |
| 684 | 435851550 |
| 685 | 20091205 |
| 686 | 21226256 |
| 687 | 88602373 |
| 688 | 88603150 |
| 689 | 336119448 |
| 690 | 83591063 |
| 691 | 304320702 |
| 692 | 403059708 |
| 693 | 118580704 |
| 694 | 194337068 |
| 695 | 253987912 |
| 696 | 91790843 |
| 697 | 330807434 |
| 698 | 392420329 |
| 699 | 93006433 |
| 700 | 226306383 |
| 701 | 192289536 |
| 702 | 90022402 |
| 703 | 378453461 |
| 704 | 383499055 |
| 705 | 16767740 |
| 706 | 378702329 |
| 707 | 379703733 |
| 708 | 378987163 |
| 709 | 378447803 |
| 710 | 378991757 |
| 711 | 330838575 |
| 712 | 117920265 |
| 713 | 113970047 |
| 714 | 257063041 |
| 715 | 284039691 |
| 716 | 313682811 |
| 717 | 427712030 |
| 718 | 114566521 |
| 719 | 114568000 |
| 720 | 85858751 |
| 721 | 438001502 |
| 722 | 332798529 |
| 723 | 217968746 |
| 724 | 410668521 |
| 725 | 304316006 |
| 726 | 390949848 |
| 727 | 431933022 |
| 728 | 229608798 |
| 729 | 360034503 |
| 730 | 260753605 |
| 731 | 83311139 |
| 732 | 83311142 |
| 733 | 120553494 |
| 734 | 186685708 |
| 735 | 338213689 |
| 736 | 336252376 |
| 737 | 336252378 |
| 738 | 257052978 |
| 739 | 257052980 |
| 740 | 169237555 |
| 741 | 169237557 |
| 742 | 222476093 |
| 743 | 222476095 |
| 744 | 344209884 |
| 745 | 344209886 |
| 746 | 345007036 |
| 747 | 345007038 |
| 748 | 433593287 |
| 749 | 433593289 |
| 750 | 296123320 |
| 751 | 220916262 |
| 752 | 262193921 |
| 753 | 262194480 |
| 754 | 302392144 |
| 755 | 117928020 |
| 756 | 392408179 |
| 757 | 150006230 |
| 758 | 312792857 |
| 759 | 219848033 |
| 760 | 317153364 |
| 761 | 146329396 |
| 762 | 289192375 |
| 763 | 289192395 |
| 764 | 336477235 |
| 765 | 189218341 |
| 766 | 83589500 |

TABLE 17-continued

SEQ ID NO. vs. Accession Number Index

| SEQ ID NO. | Accession No. |
|---|---|
| 767 | 77163603 |
| 768 | 300112782 |
| 769 | 154251634 |
| 770 | 154253986 |
| 771 | 325107712 |
| 772 | 297617452 |
| 773 | 297617463 |
| 774 | 438003073 |
| 775 | 332799809 |
| 776 | 269793099 |
| 777 | 320115755 |
| 778 | 289578545 |
| 779 | 167037339 |
| 780 | 390935377 |
| 781 | 433655486 |
| 782 | 333896806 |
| 783 | 83719623 |
| 784 | 257094926 |
| 785 | 383457202 |
| 786 | 383457204 |
| 787 | 340794637 |
| 788 | 86741641 |
| 789 | 312199460 |
| 790 | 262194454 |
| 791 | 262194456 |
| 792 | 336118509 |
| 793 | 302865796 |
| 794 | 145223789 |
| 795 | 379708000 |
| 796 | 121582862 |
| 797 | 257054591 |
| 798 | 134101639 |
| 799 | 433603653 |
| 800 | 430742881 |
| 801 | 162455964 |
| 802 | 21224932 |
| 803 | 182435399 |
| 804 | 72161113 |
| 805 | 296269522 |
| 806 | 83646203 |
| 807 | 432329234 |
| 808 | 392407895 |
| 809 | 169830968 |
| 810 | 206896068 |
| 811 | 428774400 |
| 812 | 428774405 |
| 813 | 291286510 |
| 814 | 431792782 |
| 815 | 253699434 |
| 816 | 327312662 |
| 817 | 148270869 |
| 818 | 396584764 |
| 819 | 458152047 |
| 820 | 472443547 |
| 821 | 336440365 |
| 822 | 432379520 |
| 823 | 374625979 |
| 824 | 424979861 |
| 825 | 472222755 |
| 826 | 419173682 |
| 827 | 331001731 |
| 828 | 375004439 |
| 829 | 421082306 |
| 830 | 417605263 |
| 831 | 332655414 |
| 832 | 373485787 |
| 833 | 417269258 |
| 834 | 363899395 |
| 835 | 419281128 |
| 836 | 262371247 |
| 837 | 260887939 |
| 838 | 262374465 |
| 839 | 418024979 |
| 840 | 472199360 |
| 841 | 419235503 |
| 842 | 352101112 |
| 843 | 229817501 |
| 844 | 443510724 |
| 845 | 407801756 |
| 846 | 424026177 |
| 847 | 443537945 |
| 848 | 329896082 |
| 849 | 433118460 |
| 850 | 307287300 |
| 851 | 470894102 |
| 852 | 420093469 |
| 853 | 443475020 |
| 854 | 423730158 |
| 855 | 458790583 |
| 856 | 458059910 |
| 857 | 320095081 |
| 858 | 373113625 |
| 859 | 421857673 |
| 860 | 422905804 |
| 861 | 421735408 |
| 862 | 293373689 |
| 863 | 424001208 |
| 864 | 410103029 |
| 865 | 301024307 |
| 866 | 317501018 |
| 867 | 472217726 |
| 868 | 423288074 |
| 869 | 425019539 |
| 870 | 238756191 |
| 871 | 398800471 |
| 872 | 433099194 |
| 873 | 457927366 |
| 874 | 419389186 |
| 875 | 229814945 |
| 876 | 422028737 |
| 877 | 442594980 |
| 878 | 407974988 |
| 879 | 432983127 |
| 880 | 457996554 |
| 881 | 458890354 |
| 882 | 425034029 |
| 883 | 254428479 |
| 884 | 424005364 |
| 885 | 418354555 |
| 886 | 450256209 |
| 887 | 313140119 |
| 888 | 419919260 |
| 889 | 458765352 |
| 890 | 449054087 |
| 891 | 386288258 |
| 892 | 359780190 |
| 893 | 366164460 |
| 894 | 317058268 |
| 895 | 314950595 |
| 896 | 458013691 |
| 897 | 422033788 |
| 898 | 422912400 |
| 899 | 296328627 |
| 900 | 294785588 |
| 901 | 262377713 |
| 902 | 418013529 |
| 903 | 432708023 |
| 904 | 293611306 |
| 905 | 423144203 |
| 906 | 223986438 |
| 907 | 430834455 |
| 908 | 336418208 |
| 909 | 237667881 |
| 910 | 417550828 |
| 911 | 388258093 |
| 912 | 257438026 |
| 913 | 114706331 |
| 914 | 415823688 |
| 915 | 301064167 |
| 916 | 425024180 |

TABLE 17-continued

SEQ ID NO. vs. Accession Number Index

| SEQ ID NO. | Accession No. |
|---|---|
| 917 | 227889976 |
| 918 | 386818311 |
| 919 | 432993617 |
| 920 | 295396111 |
| 921 | 419200149 |
| 922 | 423719993 |
| 923 | 423926650 |
| 924 | 424977971 |
| 925 | 424971164 |
| 926 | 229509126 |
| 927 | 340357065 |
| 928 | 424023373 |
| 929 | 424612433 |
| 930 | 443530596 |
| 931 | 424605794 |
| 932 | 357040625 |
| 933 | 443522967 |
| 934 | 425047890 |
| 935 | 149189596 |
| 936 | 386775208 |
| 937 | 427597640 |
| 938 | 389577851 |
| 939 | 442610063 |
| 940 | 182624228 |
| 941 | 314992449 |
| 942 | 153821425 |
| 943 | 419887467 |
| 944 | 472214607 |
| 945 | 422901580 |
| 946 | 404368577 |
| 947 | 86139886 |
| 948 | 419281501 |
| 949 | 357010162 |
| 950 | 419206641 |
| 951 | 407366555 |
| 952 | 440708892 |
| 953 | 424651810 |
| 954 | 472210701 |
| 955 | 196250357 |
| 956 | 432551902 |
| 957 | 427557941 |
| 958 | 210635261 |
| 959 | 381395616 |
| 960 | 422702473 |
| 961 | 409203050 |
| 962 | 432531965 |
| 963 | 358066714 |
| 964 | 421345612 |
| 965 | 417812642 |
| 966 | 401676815 |
| 967 | 314996685 |
| 968 | 421334490 |
| 969 | 423535444 |
| 970 | 314939179 |
| 971 | 167991284 |
| 972 | 422924884 |
| 973 | 423891876 |
| 974 | 419378582 |
| 975 | 427682140 |
| 976 | 423480949 |
| 977 | 421772573 |
| 978 | 448689857 |
| 979 | 421768511 |
| 980 | 427622024 |
| 981 | 343503399 |
| 982 | 472166842 |
| 983 | 418348068 |
| 984 | 427576009 |
| 985 | 419252317 |
| 986 | 227544817 |
| 987 | 443506619 |
| 988 | 424609629 |
| 989 | 432566736 |
| 990 | 431640910 |
| 991 | 472149947 |
| 992 | 417209350 |
| 993 | 390169177 |
| 994 | 443502704 |
| 995 | 424644167 |
| 996 | 458688573 |
| 997 | 404330919 |
| 998 | 472157766 |
| 999 | 302520233 |
| 1000 | 427658745 |
| 1001 | 424974920 |
| 1002 | 417589501 |
| 1003 | 294807071 |
| 1004 | 419363098 |
| 1005 | 419363099 |
| 1006 | 345508160 |
| 1007 | 373849352 |
| 1008 | 410618146 |
| 1009 | 224023322 |
| 1010 | 298384281 |
| 1011 | 298384294 |
| 1012 | 419358136 |
| 1013 | 419358137 |
| 1014 | 419352607 |
| 1015 | 419352608 |
| 1016 | 417224010 |
| 1017 | 417225258 |
| 1018 | 381159246 |
| 1019 | 282900778 |
| 1020 | 425444980 |
| 1021 | 472183766 |
| 1022 | 424655758 |
| 1023 | 334125671 |
| 1024 | 126665995 |
| 1025 | 423709629 |
| 1026 | 437842751 |
| 1027 | 418008631 |
| 1028 | 431534713 |
| 1029 | 410637164 |
| 1030 | 363897443 |
| 1031 | 472152152 |
| 1032 | 419240871 |
| 1033 | 419383944 |
| 1034 | 424630790 |
| 1035 | 374629429 |
| 1036 | 374630018 |
| 1037 | 418342902 |
| 1038 | 420088375 |
| 1039 | 255743727 |
| 1040 | 443518100 |
| 1041 | 206975617 |
| 1042 | 423164024 |
| 1043 | 417522346 |
| 1044 | 419832016 |
| 1045 | 139439065 |
| 1046 | 314941481 |
| 1047 | 423147141 |
| 1048 | 255014565 |
| 1049 | 422306080 |
| 1050 | 254850928 |
| 1051 | 417815511 |
| 1052 | 425040993 |
| 1053 | 340752704 |
| 1054 | 423878986 |
| 1055 | 90418997 |
| 1056 | 418398870 |
| 1057 | 381199747 |
| 1058 | 402700381 |
| 1059 | 260101568 |
| 1060 | 443514286 |
| 1061 | 160944224 |
| 1062 | 358012808 |
| 1063 | 383114787 |
| 1064 | 425069876 |
| 1065 | 265757019 |
| 1066 | 427646244 |

TABLE 17-continued

SEQ ID NO. vs. Accession Number Index

| SEQ ID NO. | Accession No. |
|---|---|
| 1067 | 404399332 |
| 1068 | 373469124 |
| 1069 | 443534358 |
| 1070 | 225374526 |
| 1071 | 167551250 |
| 1072 | 365096843 |
| 1073 | 298528556 |
| 1074 | 395208610 |
| 1075 | 458920176 |
| 1076 | 419246582 |
| 1077 | 423155504 |
| 1078 | 421624973 |
| 1079 | 427425586 |
| 1080 | 458913829 |
| 1081 | 417191550 |
| 1082 | 424621187 |
| 1083 | 262405137 |
| 1084 | 422890703 |
| 1085 | 419230121 |
| 1086 | 424015510 |
| 1087 | 335043947 |
| 1088 | 419894757 |
| 1089 | 472202871 |
| 1090 | 89073847 |
| 1091 | 424618575 |
| 1092 | 237744599 |
| 1093 | 169343946 |
| 1094 | 405982586 |
| 1095 | 431753901 |
| 1096 | 417292957 |
| 1097 | 418336066 |
| 1098 | 423152698 |
| 1099 | 419841735 |
| 1100 | 421338422 |
| 1101 | 325918007 |
| 1102 | 366087502 |
| 1103 | 294645433 |
| 1104 | 294645434 |
| 1105 | 419368080 |
| 1106 | 419368151 |
| 1107 | 419343546 |
| 1108 | 419343547 |
| 1109 | 365831806 |
| 1110 | 365831811 |
| 1111 | 448302568 |
| 1112 | 448302570 |
| 1113 | 448682078 |
| 1114 | 448682080 |
| 1115 | 448413236 |
| 1116 | 448413238 |
| 1117 | 470888966 |
| 1118 | 443475072 |
| 1119 | 386811046 |
| 1120 | 196035162 |
| 1121 | 419725844 |
| 1122 | 336426892 |
| 1123 | 257885934 |
| 1124 | 397905666 |
| 1125 | 392538885 |
| 1126 | 323701234 |
| 1127 | 288575102 |
| 1128 | 325266723 |
| 1129 | 408373945 |
| 1130 | 423398559 |
| 1131 | 254435628 |
| 1132 | 334130736 |
| 1133 | 472439490 |
| 1134 | 398889059 |
| 1135 | 196044278 |
| 1136 | 374812241 |
| 1137 | 415887047 |
| 1138 | 343509540 |
| 1139 | 381156866 |
| 1140 | 374623710 |
| 1141 | 326204498 |
| 1142 | 326389943 |
| 1143 | 256752454 |
| 1144 | 256752455 |
| 1145 | 88811250 |
| 1146 | 384564491 |
| 1147 | 453074722 |
| 1148 | 375098941 |
| 1149 | 359765506 |
| 1150 | 451335435 |
| 1151 | 126666537 |
| 1152 | 291003193 |
| 1153 | 440700790 |
| 1154 | 168697899 |
| 1155 | 458780598 |
| 1156 | 383824740 |
| 1157 | 238063221 |
| 1158 | 383828986 |
| 1159 | 365878960 |
| 1160 | 257140679 |
| 1161 | 149176310 |
| 1162 | 458859660 |
| 1163 | 441515890 |
| 1164 | 254821511 |
| 1165 | 381168766 |
| 1166 | 88810589 |
| 1167 | 288920050 |
| 1168 | 452746643 |
| 1169 | 319947887 |
| 1170 | 2530355709 |
| 1171 | 458067974 |
| 1172 | 650306799 |
| 1173 | 373106085 |
| 1174 | 373106629 |
| 1175 | 2520346679 |
| 1176 | 643625575 |
| 1177 | 640526658 |
| 1178 | 643706988 |
| 1179 | 2506688733 |
| 1180 | 378443454 |
| 1181 | 644886776 |
| 1182 | 649671143 |
| 1183 | 326402148 |
| 1184 | 344198243 |
| 1185 | 169786889 |
| 1186 | 407698262 |
| 1187 | 86156430 |
| 1188 | 56475432 |
| 1189 | 146351220 |
| 1190 | 374998023 |
| 1191 | 386866198 |
| 1192 | 410470815 |
| 1193 | 323524377 |
| 1194 | 330814956 |
| 1195 | 134294128 |
| 1196 | 313671969 |
| 1197 | 78042616 |
| 1198 | 189499000 |
| 1199 | 374294493 |
| 1200 | 374294493 |
| 1201 | 300853232 |
| 1202 | 302384444 |
| 1203 | 302384444 |
| 1204 | 339441064 |
| 1205 | 339324158 |
| 1206 | 257057919 |
| 1207 | 270307451 |
| 1208 | 300087139 |
| 1209 | 89892746 |
| 1210 | 408417460 |
| 1211 | 256827818 |
| 1212 | 402570638 |
| 1213 | 239904639 |
| 1214 | 46562128 |
| 1215 | 387151873 |
| 1216 | 297567992 |

TABLE 17-continued

SEQ ID NO. vs. Accession Number Index

| SEQ ID NO. | Accession No. |
|---|---|
| 1217 | 401761514 |
| 1218 | 385785459 |
| 1219 | 387869382 |
| 1220 | 259906682 |
| 1221 | 85372828 |
| 1222 | 386632422 |
| 1223 | 386627502 |
| 1224 | 157159467 |
| 1225 | 260866153 |
| 1226 | 218561636 |
| 1227 | 172056045 |
| 1228 | 347534971 |
| 1229 | 302877245 |
| 1230 | 302877245 |
| 1231 | 239825584 |
| 1232 | 400756305 |
| 1233 | 332661890 |
| 1234 | 386712343 |
| 1235 | 435852812 |
| 1236 | 397655102 |
| 1237 | 385816611 |
| 1238 | 301065125 |
| 1239 | 385812838 |
| 1240 | 403514032 |
| 1241 | 268318562 |
| 1242 | 338202359 |
| 1243 | 385826720 |
| 1244 | 258506995 |
| 1245 | 296110131 |
| 1246 | 148642060 |
| 1247 | 397779166 |
| 1248 | 409187964 |
| 1249 | 435850242 |
| 1250 | 20088899 |
| 1251 | 21226102 |
| 1252 | 88601322 |
| 1253 | 88601322 |
| 1254 | 336115651 |
| 1255 | 83588874 |
| 1256 | 304319677 |
| 1257 | 403056439 |
| 1258 | 118578449 |
| 1259 | 194335182 |
| 1260 | 91790731 |
| 1261 | 330806657 |
| 1262 | 392419087 |
| 1263 | 93004831 |
| 1264 | 226303489 |
| 1265 | 192288433 |
| 1266 | 90019649 |
| 1267 | 378448274 |
| 1268 | 383494824 |
| 1269 | 16763390 |
| 1270 | 378697983 |
| 1271 | 379699217 |
| 1272 | 378982542 |
| 1273 | 378987404 |
| 1274 | 330837866 |
| 1275 | 117918459 |
| 1276 | 113968346 |
| 1277 | 257062754 |
| 1278 | 284034943 |
| 1279 | 313681130 |
| 1280 | 427711179 |
| 1281 | 114565576 |
| 1282 | 114565576 |
| 1283 | 85857845 |
| 1284 | 438000910 |
| 1285 | 332798023 |
| 1286 | 237653092 |
| 1287 | 409131816 |
| 1288 | 304315537 |
| 1289 | 390948458 |
| 1290 | 431932943 |
| 1291 | 229606122 |
| 1292 | 360034408 |
| 1293 | 260752245 |
| 1294 | 83309099 |
| 1295 | 120552944 |
| 1296 | 186680550 |
| 1297 | 146279170 |
| 1298 | 338209545 |
| 1299 | 257051090 |
| 1300 | 169237353 |
| 1301 | 344209485 |
| 1302 | 345006827 |
| 1303 | 433593057 |
| 1304 | 296120274 |
| 1305 | 220915123 |
| 1306 | 262193326 |
| 1307 | 262193326 |
| 1308 | 302390797 |
| 1309 | 117927211 |
| 1310 | 392406391 |
| 1311 | 150002608 |
| 1312 | 312792283 |
| 1313 | 219846956 |
| 1314 | 317151727 |
| 1315 | 146328629 |
| 1316 | 289191496 |
| 1317 | 336475959 |
| 1318 | 189218017 |
| 1319 | 83588874 |
| 1320 | 77163561 |
| 1321 | 300112745 |
| 1322 | 154250456 |
| 1323 | 154250456 |
| 1324 | 325106586 |
| 1325 | 297616214 |
| 1326 | 438000910 |
| 1327 | 332798023 |
| 1328 | 269791619 |
| 1329 | 320114857 |
| 1330 | 289577265 |
| 1331 | 167036431 |
| 1332 | 390933132 |
| 1333 | 433653743 |
| 1334 | 333895862 |
| 1335 | 83718394 |
| 1336 | 257091663 |
| 1337 | 383452024 |
| 1338 | 340792956 |
| 1339 | 86738724 |
| 1340 | 312193897 |
| 1341 | 262193326 |
| 1342 | 336115651 |
| 1343 | 302864508 |
| 1344 | 145220606 |
| 1345 | 379706264 |
| 1346 | 121582711 |
| 1347 | 257054089 |
| 1348 | 134096620 |
| 1349 | 433601838 |
| 1350 | 430741030 |
| 1351 | 162448269 |
| 1352 | 32141095 |
| 1353 | 182433793 |
| 1354 | 72160406 |
| 1355 | 296267998 |
| 1356 | 83642913 |
| 1357 | 432327926 |
| 1358 | 392406391 |
| 1359 | 169830219 |
| 1360 | 206895078 |
| 1361 | 428771848 |
| 1362 | 291285947 |
| 1363 | 431792069 |
| 1364 | 253698656 |
| 1365 | 327312315 |
| 1366 | 148269145 |

TABLE 17-continued

SEQ ID NO. vs. Accession Number Index

| SEQ ID NO. | Accession No. |
|---|---|
| 1367 | 396584758 |
| 1368 | 452732384 |
| 1369 | 472443541 |
| 1370 | 336440820 |
| 1371 | 476380507 |
| 1372 | 374627927 |
| 1373 | 424979852 |
| 1374 | 472222746 |
| 1375 | 419173668 |
| 1376 | 331640257 |
| 1377 | 331640257 |
| 1378 | 375004550 |
| 1379 | 421082290 |
| 1380 | 417605122 |
| 1381 | 332655353 |
| 1382 | 373485774 |
| 1383 | 417268567 |
| 1384 | 363900611 |
| 1385 | 419280801 |
| 1386 | 262371200 |
| 1387 | 256402721 |
| 1388 | 262374339 |
| 1389 | 418024796 |
| 1390 | 472199351 |
| 1391 | 419235449 |
| 1392 | 352101099 |
| 1393 | 226597601 |
| 1394 | 455877139 |
| 1395 | 407801688 |
| 1396 | 424026168 |
| 1397 | 443537933 |
| 1398 | 329896015 |
| 1399 | 433118449 |
| 1400 | 313151045 |
| 1401 | 470894026 |
| 1402 | 420093456 |
| 1403 | 443474995 |
| 1404 | 423730148 |
| 1405 | 452301294 |
| 1406 | 452281584 |
| 1407 | 320096521 |
| 1408 | 373114969 |
| 1409 | 421857666 |
| 1410 | 422905795 |
| 1411 | 421735395 |
| 1412 | 293373625 |
| 1413 | 424001199 |
| 1414 | 410105720 |
| 1415 | 301030692 |
| 1416 | 319430354 |
| 1417 | 472217717 |
| 1418 | 423286106 |
| 1419 | 425019536 |
| 1420 | 238756169 |
| 1421 | 398800292 |
| 1422 | 433099189 |
| 1423 | 452722814 |
| 1424 | 419389168 |
| 1425 | 242362072 |
| 1426 | 422028620 |
| 1427 | 442594974 |
| 1428 | 407974869 |
| 1429 | 476381541 |
| 1430 | 452704090 |
| 1431 | 452743095 |
| 1432 | 425034026 |
| 1433 | 254426770 |
| 1434 | 424005355 |
| 1435 | 418354477 |
| 1436 | 450256199 |
| 1437 | 223955923 |
| 1438 | 419919231 |
| 1439 | 452722284 |
| 1440 | 449053971 |
| 1441 | 386289604 |
| 1442 | 359780050 |
| 1443 | 411116154 |
| 1444 | 224581172 |
| 1445 | 314953942 |
| 1446 | 452301765 |
| 1447 | 422033758 |
| 1448 | 422912392 |
| 1449 | 296328579 |
| 1450 | 294784664 |
| 1451 | 262377679 |
| 1452 | 418013522 |
| 1453 | 476381295 |
| 1454 | 293611286 |
| 1455 | 423144195 |
| 1456 | 224581037 |
| 1457 | 469923807 |
| 1458 | 336420422 |
| 1459 | 237666990 |
| 1460 | 417550237 |
| 1461 | 390606126 |
| 1462 | 254692771 |
| 1463 | 211594571 |
| 1464 | 415823418 |
| 1465 | 301064104 |
| 1466 | 425024171 |
| 1467 | 238694717 |
| 1468 | 386814329 |
| 1469 | 476381563 |
| 1470 | 295396063 |
| 1471 | 419200062 |
| 1472 | 423718272 |
| 1473 | 423926641 |
| 1474 | 424977968 |
| 1475 | 424971161 |
| 1476 | 229509077 |
| 1477 | 340358330 |
| 1478 | 424023365 |
| 1479 | 424612424 |
| 1480 | 443530314 |
| 1481 | 424605785 |
| 1482 | 357040530 |
| 1483 | 455967306 |
| 1484 | 425047878 |
| 1485 | 149189552 |
| 1486 | 385881638 |
| 1487 | 427597607 |
| 1488 | 389575461 |
| 1489 | 442610050 |
| 1490 | 182624174 |
| 1491 | 314994688 |
| 1492 | 211595724 |
| 1493 | 419887425 |
| 1494 | 472214599 |
| 1495 | 422901577 |
| 1496 | 406351917 |
| 1497 | 225001047 |
| 1498 | 419281346 |
| 1499 | 356907979 |
| 1500 | 419206516 |
| 1501 | 406839856 |
| 1502 | 440708760 |
| 1503 | 424651801 |
| 1504 | 472210693 |
| 1505 | 196250231 |
| 1506 | 476380904 |
| 1507 | 427557910 |
| 1508 | 224515124 |
| 1509 | 381395491 |
| 1510 | 422702452 |
| 1511 | 409167416 |
| 1512 | 476380862 |
| 1513 | 358069018 |
| 1514 | 421345543 |
| 1515 | 417812631 |
| 1516 | 401676751 |

TABLE 17-continued

SEQ ID NO. vs. Accession Number Index

| SEQ ID NO. | Accession No. |
|---|---|
| 1517 | 314998443 |
| 1518 | 421334477 |
| 1519 | 423532168 |
| 1520 | 314940712 |
| 1521 | 149113251 |
| 1522 | 422924875 |
| 1523 | 423891867 |
| 1524 | 419378419 |
| 1525 | 427682108 |
| 1526 | 423480222 |
| 1527 | 421772441 |
| 1528 | 448689403 |
| 1529 | 421768382 |
| 1530 | 427621994 |
| 1531 | 343503287 |
| 1532 | 472166833 |
| 1533 | 418348058 |
| 1534 | 427575979 |
| 1535 | 419252283 |
| 1536 | 251833313 |
| 1537 | 455819031 |
| 1538 | 424609621 |
| 1539 | 476380950 |
| 1540 | 469924283 |
| 1541 | 472149938 |
| 1542 | 417209278 |
| 1543 | 390169096 |
| 1544 | 455593728 |
| 1545 | 424644158 |
| 1546 | 452702507 |
| 1547 | 399579771 |
| 1548 | 472157757 |
| 1549 | 224581092 |
| 1550 | 427658715 |
| 1551 | 424974911 |
| 1552 | 417589425 |
| 1553 | 294807000 |
| 1554 | 419362951 |
| 1555 | 427663999 |
| 1556 | 345651578 |
| 1557 | 373849145 |
| 1558 | 410618100 |
| 1559 | 224485776 |
| 1560 | 298384183 |
| 1561 | 419358064 |
| 1562 | 419352509 |
| 1563 | 417223690 |
| 1564 | 381157709 |
| 1565 | 282900768 |
| 1566 | 425444918 |
| 1567 | 472183758 |
| 1568 | 424655749 |
| 1569 | 334126448 |
| 1570 | 126665966 |
| 1571 | 423709466 |
| 1572 | 437842748 |
| 1573 | 418008622 |
| 1574 | 469924241 |
| 1575 | 410637153 |
| 1576 | 363898451 |
| 1577 | 472152144 |
| 1578 | 419240736 |
| 1579 | 419383938 |
| 1580 | 424630728 |
| 1581 | 374627936 |
| 1582 | 374627936 |
| 1583 | 418342894 |
| 1584 | 420088308 |
| 1585 | 255743719 |
| 1586 | 455929923 |
| 1587 | 206975561 |
| 1588 | 423164021 |
| 1589 | 417522340 |
| 1590 | 419831962 |
| 1591 | 139439021 |
| 1592 | 314944229 |
| 1593 | 423147095 |
| 1594 | 224485442 |
| 1595 | 422305960 |
| 1596 | 225363921 |
| 1597 | 417815500 |
| 1598 | 425040990 |
| 1599 | 343177620 |
| 1600 | 423878932 |
| 1601 | 211593993 |
| 1602 | 418398711 |
| 1603 | 378759082 |
| 1604 | 402296507 |
| 1605 | 259048327 |
| 1606 | 455905617 |
| 1607 | 224514842 |
| 1608 | 357631901 |
| 1609 | 384096966 |
| 1610 | 425069205 |
| 1611 | 265756999 |
| 1612 | 427646214 |
| 1613 | 403955718 |
| 1614 | 373471569 |
| 1615 | 373471569 |
| 1616 | 456039135 |
| 1617 | 224993695 |
| 1618 | 149109670 |
| 1619 | 365096837 |
| 1620 | 298527635 |
| 1621 | 395208219 |
| 1622 | 458920171 |
| 1623 | 419246266 |
| 1624 | 423155496 |
| 1625 | 421624890 |
| 1626 | 427425534 |
| 1627 | 458913812 |
| 1628 | 417191381 |
| 1629 | 424621178 |
| 1630 | 262405036 |
| 1631 | 422890700 |
| 1632 | 419229938 |
| 1633 | 424015456 |
| 1634 | 335043876 |
| 1635 | 419894708 |
| 1636 | 472202862 |
| 1637 | 211594035 |
| 1638 | 424618529 |
| 1639 | 224581212 |
| 1640 | 169343945 |
| 1641 | 405982616 |
| 1642 | 469924367 |
| 1643 | 417292897 |
| 1644 | 418336054 |
| 1645 | 423152690 |
| 1646 | 419841668 |
| 1647 | 421338374 |
| 1648 | 325917999 |
| 1649 | 365822320 |
| 1650 | 294645413 |
| 1651 | 419367985 |
| 1652 | 419343475 |
| 1653 | 365833706 |
| 1654 | 448302553 |
| 1655 | 448681954 |
| 1656 | 448413196 |
| 1657 | 470888868 |
| 1658 | 443475057 |
| 1659 | 386810750 |
| 1660 | 196035064 |
| 1661 | 419725778 |
| 1662 | 336430981 |
| 1663 | 242355593 |
| 1664 | 397905651 |
| 1665 | 390993910 |
| 1666 | 323701113 |

TABLE 17-continued

SEQ ID NO. vs. Accession Number Index

| SEQ ID NO. | Accession No. |
|---|---|
| 1667 | 288572734 |
| 1668 | 325672510 |
| 1669 | 408373871 |
| 1670 | 423394306 |
| 1671 | 254434980 |
| 1672 | 334130722 |
| 1673 | 472439485 |
| 1674 | 398888999 |
| 1675 | 196044104 |
| 1676 | 374534854 |
| 1677 | 415887008 |
| 1678 | 343509531 |
| 1679 | 381156824 |
| 1680 | 374623705 |
| 1681 | 326204471 |
| 1682 | 326389902 |
| 1683 | 256752440 |
| 1684 | 211606481 |
| 1685 | 384563951 |
| 1686 | 453074660 |
| 1687 | 375098335 |
| 1688 | 359765453 |
| 1689 | 451335404 |
| 1690 | 126666487 |
| 1691 | 257461537 |
| 1692 | 440700728 |
| 1693 | 163804182 |
| 1694 | 458780588 |
| 1695 | 383824531 |
| 1696 | 224581088 |
| 1697 | 383827549 |
| 1698 | 365878943 |
| 1699 | 254173939 |
| 1700 | 149176214 |
| 1701 | 458859600 |
| 1702 | 441515884 |
| 1703 | 163719735 |
| 1704 | 381168746 |
| 1705 | 211606481 |
| 1706 | 288920043 |
| 1707 | 452746574 |
| 1708 | 319947885 |
| 1709 | 2530355715 |
| 1710 | MMU_RS00550 |
| 1711 | 650306804 |
| 1712 | 373108119 |
| 1713 | 373108120 |
| 1714 | 643625571 |
| 1715 | 640526658 |
| 1716 | 326402589 |
| 1717 | 344200473 |
| 1718 | 169786939 |
| 1719 | 407700176 |
| 1720 | 86159652 |
| 1721 | 56478415 |
| 1722 | 403571622 |
| 1723 | 374998144 |
| 1724 | 386867051 |
| 1725 | 410471301 |
| 1726 | 323527064 |
| 1727 | 330816350 |
| 1728 | 134296116 |
| 1729 | 313673969 |
| 1730 | 78043267 |
| 1731 | 189500606 |
| 1732 | 374294728 |
| 1733 | 374297210 |
| 1734 | 300856433 |
| 1735 | 302387132 |
| 1736 | 302388010 |
| 1737 | 310658344 |
| 1738 | 339442908 |
| 1739 | 339327415 |
| 1740 | 257060032 |
| 1741 | 270307691 |
| 1742 | 300088701 |
| 1743 | 89893425 |
| 1744 | 408420308 |
| 1745 | 256829110 |
| 1746 | 402570964 |
| 1747 | 239908248 |
| 1748 | 46580427 |
| 1749 | 387153160 |
| 1750 | 297570104 |
| 1751 | 401762036 |
| 1752 | 385787387 |
| 1753 | 387872414 |
| 1754 | 259909434 |
| 1755 | 85375777 |
| 1756 | 386637214 |
| 1757 | 386632294 |
| 1758 | 157159793 |
| 1759 | 260871022 |
| 1760 | 218561662 |
| 1761 | 172056359 |
| 1762 | 347535914 |
| 1763 | 302878127 |
| 1764 | 302878745 |
| 1765 | 239826791 |
| 1766 | 39997204 |
| 1767 | 332661904 |
| 1768 | 386716365 |
| 1769 | 435853828 |
| 1770 | 397655645 |
| 1771 | 385817611 |
| 1772 | 301067090 |
| 1773 | 385813804 |
| 1774 | 403515031 |
| 1775 | 268319503 |
| 1776 | 338203664 |
| 1777 | 385828733 |
| 1778 | 258509089 |
| 1779 | 296110175 |
| 1780 | 148643813 |
| 1781 | 397780109 |
| 1782 | 410669363 |
| 1783 | 435851539 |
| 1784 | 20091198 |
| 1785 | 21226265 |
| 1786 | 88602368 |
| 1787 | 88603159 |
| 1788 | 336119454 |
| 1789 | 83591058 |
| 1790 | 304320700 |
| 1791 | 403059710 |
| 1792 | 118580699 |
| 1793 | 194337071 |
| 1794 | 253987914 |
| 1795 | 91790850 |
| 1796 | 330807437 |
| 1797 | 392420322 |
| 1798 | 93006431 |
| 1799 | 226306381 |
| 1800 | 192289538 |
| 1801 | 90022398 |
| 1802 | 378453457 |
| 1803 | 383499051 |
| 1804 | 16767736 |
| 1805 | 378702325 |
| 1806 | 379703729 |
| 1807 | 378987159 |
| 1808 | 378447799 |
| 1809 | 378991753 |
| 1810 | 330838578 |
| 1811 | 117920268 |
| 1812 | 113970050 |
| 1813 | 257063040 |
| 1814 | 284039695 |
| 1815 | 313682819 |
| 1816 | 427712035 |

TABLE 17-continued

SEQ ID NO. vs. Accession Number Index

| SEQ ID NO. | Accession No. |
|---|---|
| 1817 | 114566529 |
| 1818 | 114567995 |
| 1819 | 85858744 |
| 1820 | 438001508 |
| 1821 | 332798532 |
| 1822 | 217968754 |
| 1823 | 410668519 |
| 1824 | 304316008 |
| 1825 | 390949842 |
| 1826 | 431933015 |
| 1827 | 229608795 |
| 1828 | 360034505 |
| 1829 | 260753607 |
| 1830 | 83311145 |
| 1831 | 120553501 |
| 1832 | 186685712 |
| 1833 | 146279744 |
| 1834 | 338213683 |
| 1835 | 336252390 |
| 1836 | 257052987 |
| 1837 | 169237549 |
| 1838 | 222476089 |
| 1839 | 344209879 |
| 1840 | 345007043 |
| 1841 | 433593294 |
| 1842 | 296123318 |
| 1843 | 220916264 |
| 1844 | 262193923 |
| 1845 | 262194482 |
| 1846 | 302392142 |
| 1847 | 117928025 |
| 1848 | 392408175 |
| 1849 | 150006234 |
| 1850 | 312792859 |
| 1851 | 219848037 |
| 1852 | 317153369 |
| 1853 | 146329856 |
| 1854 | 289192377 |
| 1855 | 336477229 |
| 1856 | 189218337 |
| 1857 | 83589503 |
| 1858 | 77163611 |
| 1859 | 300112789 |
| 1860 | 154251629 |
| 1861 | 154253991 |
| 1862 | 325107708 |
| 1863 | 297617450 |
| 1864 | 438003071 |
| 1865 | 332799807 |
| 1866 | 269793094 |
| 1867 | 320115758 |
| 1868 | 289578542 |
| 1869 | 167037342 |
| 1870 | 390935374 |
| 1871 | 433655483 |
| 1872 | 333896809 |
| 1873 | 83719262 |
| 1874 | 257094925 |
| 1875 | 383457203 |
| 1876 | 340794638 |
| 1877 | 86741642 |
| 1878 | 312199461 |
| 1879 | 262194455 |
| 1880 | 336118508 |
| 1881 | 302865797 |
| 1882 | 145223788 |
| 1883 | 379707999 |
| 1884 | 121582861 |
| 1885 | 257054592 |
| 1886 | 134101638 |
| 1887 | 433603652 |
| 1888 | 430742880 |
| 1889 | 162455967 |
| 1890 | 21224933 |
| 1891 | 182435400 |
| 1892 | 72161114 |
| 1893 | 296269523 |
| 1894 | 83646202 |
| 1895 | 432329233 |
| 1896 | 392407894 |
| 1897 | 169830970 |
| 1898 | 206895399 |
| 1899 | 428774399 |
| 1900 | 291286511 |
| 1901 | 431792783 |
| 1902 | 253699435 |
| 1903 | 327312663 |
| 1904 | 148270870 |
| 1905 | 373106087 |
| 1906 | 373106623 |
| 1907 | 458152051 |
| 1908 | 472443552 |
| 1909 | 336440358 |
| 1910 | 432379518 |
| 1911 | 374625983 |
| 1912 | 424979859 |
| 1913 | 472222757 |
| 1914 | 419173696 |
| 1915 | 331001737 |
| 1916 | 331001745 |
| 1917 | 375004435 |
| 1918 | 421082302 |
| 1919 | 417605260 |
| 1920 | 332655411 |
| 1921 | 373485791 |
| 1922 | 417269719 |
| 1923 | 363899392 |
| 1924 | 419281125 |
| 1925 | 262371244 |
| 1926 | 260887934 |
| 1927 | 262374467 |
| 1928 | 418024984 |
| 1929 | 472199362 |
| 1930 | 419235606 |
| 1931 | 352101104 |
| 1932 | 229817507 |
| 1933 | 443510726 |
| 1934 | 407801761 |
| 1935 | 424026179 |
| 1936 | 443537947 |
| 1937 | 329896080 |
| 1938 | 433118458 |
| 1939 | 307287305 |
| 1940 | 470894093 |
| 1941 | 420093471 |
| 1942 | 443475015 |
| 1943 | 423730160 |
| 1944 | 458790581 |
| 1945 | 458059908 |
| 1946 | 320095085 |
| 1947 | 373113613 |
| 1948 | 421857675 |
| 1949 | 422905806 |
| 1950 | 421735404 |
| 1951 | 293373679 |
| 1952 | 424001210 |
| 1953 | 410103021 |
| 1954 | 301024303 |
| 1955 | 317501025 |
| 1956 | 472217728 |
| 1957 | 423288070 |
| 1958 | 425019541 |
| 1959 | 238756193 |
| 1960 | 398800475 |
| 1961 | 433099192 |
| 1962 | 457927368 |
| 1963 | 419389183 |
| 1964 | 229814938 |
| 1965 | 422028733 |
| 1966 | 442594982 |

TABLE 17-continued

SEQ ID NO. vs. Accession Number Index

| SEQ ID NO. | Accession No. |
|---|---|
| 1967 | 407974986 |
| 1968 | 432983129 |
| 1969 | 457996556 |
| 1970 | 458890355 |
| 1971 | 425034031 |
| 1972 | 254428445 |
| 1973 | 424005366 |
| 1974 | 418354592 |
| 1975 | 450256206 |
| 1976 | 313140123 |
| 1977 | 419919256 |
| 1978 | 458765348 |
| 1979 | 449054084 |
| 1980 | 386288263 |
| 1981 | 359780188 |
| 1982 | 366164456 |
| 1983 | 317058272 |
| 1984 | 314950593 |
| 1985 | 458013693 |
| 1986 | 422033784 |
| 1987 | 422912402 |
| 1988 | 296328617 |
| 1989 | 294785577 |
| 1990 | 262377716 |
| 1991 | 418013525 |
| 1992 | 432708025 |
| 1993 | 293611309 |
| 1994 | 423144205 |
| 1995 | 223986436 |
| 1996 | 430834453 |
| 1997 | 336418215 |
| 1998 | 237668352 |
| 1999 | 417551043 |
| 2000 | 388258086 |
| 2001 | 257438023 |
| 2002 | 114706329 |
| 2003 | 415823686 |
| 2004 | 301064130 |
| 2005 | 425024178 |
| 2006 | 227889982 |
| 2007 | 386818318 |
| 2008 | 432993619 |
| 2009 | 295396108 |
| 2010 | 419200147 |
| 2011 | 423719995 |
| 2012 | 423926652 |
| 2013 | 424977973 |
| 2014 | 424971166 |
| 2015 | 229509123 |
| 2016 | 340357070 |
| 2017 | 424023375 |
| 2018 | 424612435 |
| 2019 | 443530598 |
| 2020 | 424605796 |
| 2021 | 357040629 |
| 2022 | 443522969 |
| 2023 | 425047888 |
| 2024 | 149189592 |
| 2025 | 386775210 |
| 2026 | 427597636 |
| 2027 | 389577845 |
| 2028 | 442610058 |
| 2029 | 182624223 |
| 2030 | 314992447 |
| 2031 | 153821427 |
| 2032 | 419887465 |
| 2033 | 472214609 |
| 2034 | 422901582 |
| 2035 | 404368579 |
| 2036 | 86139884 |
| 2037 | 419281499 |
| 2038 | 357010160 |
| 2039 | 419206669 |
| 2040 | 407366548 |
| 2041 | 440708896 |
| 2042 | 424651812 |
| 2043 | 472210703 |
| 2044 | 196250354 |
| 2045 | 432551906 |
| 2046 | 427557937 |
| 2047 | 210635282 |
| 2048 | 381395620 |
| 2049 | 422702478 |
| 2050 | 409203047 |
| 2051 | 432531963 |
| 2052 | 358066709 |
| 2053 | 421345630 |
| 2054 | 417812644 |
| 2055 | 401676817 |
| 2056 | 314996687 |
| 2057 | 421334492 |
| 2058 | 423535442 |
| 2059 | 314939177 |
| 2060 | 167991280 |
| 2061 | 422924886 |
| 2062 | 423891878 |
| 2063 | 419378578 |
| 2064 | 427682136 |
| 2065 | 423480951 |
| 2066 | 421772577 |
| 2067 | 448689853 |
| 2068 | 421768507 |
| 2069 | 427622020 |
| 2070 | 343503401 |
| 2071 | 472166844 |
| 2072 | 418348070 |
| 2073 | 427576005 |
| 2074 | 419252314 |
| 2075 | 227544813 |
| 2076 | 443506621 |
| 2077 | 424609631 |
| 2078 | 432566738 |
| 2079 | 431639958 |
| 2080 | 472149949 |
| 2081 | 417209331 |
| 2082 | 390169173 |
| 2083 | 443502706 |
| 2084 | 424644169 |
| 2085 | 458688571 |
| 2086 | 404330917 |
| 2087 | 472157768 |
| 2088 | 302520231 |
| 2089 | 427658741 |
| 2090 | 424974918 |
| 2091 | 417589498 |
| 2092 | 294807066 |
| 2093 | 419363095 |
| 2094 | 427664025 |
| 2095 | 345508156 |
| 2096 | 373849343 |
| 2097 | 410618144 |
| 2098 | 224023319 |
| 2099 | 298384292 |
| 2100 | 419358133 |
| 2101 | 419352603 |
| 2102 | 417224519 |
| 2103 | 381159257 |
| 2104 | 282900772 |
| 2105 | 425444986 |
| 2106 | 472183768 |
| 2107 | 424655760 |
| 2108 | 334125675 |
| 2109 | 126665990 |
| 2110 | 423709627 |
| 2111 | 437842750 |
| 2112 | 418008627 |
| 2113 | 431534715 |
| 2114 | 410637166 |
| 2115 | 363897438 |
| 2116 | 472152154 |

TABLE 17-continued

SEQ ID NO. vs. Accession Number Index

| SEQ ID NO. | Accession No. |
|---|---|
| 2117 | 419240868 |
| 2118 | 419383941 |
| 2119 | 424630788 |
| 2120 | 374629423 |
| 2121 | 374630014 |
| 2122 | 418342904 |
| 2123 | 420088373 |
| 2124 | 255743729 |
| 2125 | 443518102 |
| 2126 | 206975748 |
| 2127 | 423164026 |
| 2128 | 417522342 |
| 2129 | 419832018 |
| 2130 | 139439069 |
| 2131 | 314941483 |
| 2132 | 423147139 |
| 2133 | 255014573 |
| 2134 | 422306083 |
| 2135 | 254850932 |
| 2136 | 417815513 |
| 2137 | 425040995 |
| 2138 | 340752711 |
| 2139 | 423878988 |
| 2140 | 90418995 |
| 2141 | 418398866 |
| 2142 | 381199749 |
| 2143 | 402700385 |
| 2144 | 260101564 |
| 2145 | 443514288 |
| 2146 | 160944230 |
| 2147 | 358012805 |
| 2148 | 383114792 |
| 2149 | 425069879 |
| 2150 | 265757016 |
| 2151 | 427646240 |
| 2152 | 404399328 |
| 2153 | 373469127 |
| 2154 | 373469128 |
| 2155 | 443534360 |
| 2156 | 225374523 |
| 2157 | 205357107 |
| 2158 | 365096849 |
| 2159 | 298528552 |
| 2160 | 395208500 |
| 2161 | 458920175 |
| 2162 | 419246580 |
| 2163 | 423155506 |
| 2164 | 421624935 |
| 2165 | 427425576 |
| 2166 | 458913826 |
| 2167 | 417191624 |
| 2168 | 424621189 |
| 2169 | 262405141 |
| 2170 | 422890705 |
| 2171 | 419230119 |
| 2172 | 424015512 |
| 2173 | 335043943 |
| 2174 | 419894755 |
| 2175 | 472202873 |
| 2176 | 89073839 |
| 2177 | 424618573 |
| 2178 | 237744587 |
| 2179 | 169343967 |
| 2180 | 405982583 |
| 2181 | 431753903 |
| 2182 | 417293167 |
| 2183 | 418336068 |
| 2184 | 423152700 |
| 2185 | 419841754 |
| 2186 | 421338420 |
| 2187 | 325918004 |
| 2188 | 366087498 |
| 2189 | 294645438 |
| 2190 | 419368013 |
| 2191 | 419343543 |
| 2192 | 365831816 |
| 2193 | 448302567 |
| 2194 | 448682071 |
| 2195 | 448413226 |
| 2196 | 470888964 |
| 2197 | 443475065 |
| 2198 | 386811037 |
| 2199 | 196035132 |
| 2200 | 419725841 |
| 2201 | 336426888 |
| 2202 | 257885936 |
| 2203 | 397905671 |
| 2204 | 392538882 |
| 2205 | 323701238 |
| 2206 | 288575095 |
| 2207 | 325266726 |
| 2208 | 408373938 |
| 2209 | 423398557 |
| 2210 | 254436183 |
| 2211 | 334130733 |
| 2212 | 472439494 |
| 2213 | 398889056 |
| 2214 | 196044220 |
| 2215 | 374812248 |
| 2216 | 415887049 |
| 2217 | 343509537 |
| 2218 | 381156859 |
| 2219 | 374623706 |
| 2220 | 326204501 |
| 2221 | 326389939 |
| 2222 | 256752458 |
| 2223 | 88811242 |
| 2224 | 384564492 |
| 2225 | 453074723 |
| 2226 | 375098942 |
| 2227 | 359765507 |
| 2228 | 451335434 |
| 2229 | 126666536 |
| 2230 | 291003194 |
| 2231 | 440700796 |
| 2232 | 168697898 |
| 2233 | 458780597 |
| 2234 | 383824741 |
| 2235 | 238063222 |
| 2236 | 383828985 |
| 2237 | 365878959 |
| 2238 | 257140678 |
| 2239 | 149176309 |
| 2240 | 458859661 |
| 2241 | 441515891 |
| 2242 | 254821513 |
| 2243 | 381168767 |
| 2244 | 88810590 |
| 2245 | 288920051 |
| 2246 | 452746644 |
| 2247 | 319947888 |
| 2248 | 2530355715 |
| 2249 | 458067972 |
| 2250 | 650306804 |
| 2251 | 644730562 |
| 2252 | 643706989 |
| 2253 | 2506688730 |
| 2254 | 378443454 |
| 2255 | 649671140 |
| 2256 | 644886775 |
| 2257 | 326402148 |
| 2258 | 326402148 |
| 2259 | 344198243 |
| 2260 | 344198243 |
| 2261 | 169786889 |
| 2262 | 407698262 |
| 2263 | 86156430 |
| 2264 | 56475432 |
| 2265 | 146351220 |
| 2266 | 374998023 |

TABLE 17-continued

SEQ ID NO. vs. Accession Number Index

| SEQ ID NO. | Accession No. |
|---|---|
| 2267 | 386866198 |
| 2268 | 323524377 |
| 2269 | 330814956 |
| 2270 | 313671969 |
| 2271 | 313671969 |
| 2272 | 78042616 |
| 2273 | 189499000 |
| 2274 | 374294493 |
| 2275 | 374294493 |
| 2276 | 374294493 |
| 2277 | 300853232 |
| 2278 | 302384444 |
| 2279 | 302384444 |
| 2280 | 302384444 |
| 2281 | 339441064 |
| 2282 | 339324158 |
| 2283 | 257057919 |
| 2284 | 257057919 |
| 2285 | 270307451 |
| 2286 | 300087139 |
| 2287 | 89892746 |
| 2288 | 408417460 |
| 2289 | 256827818 |
| 2290 | 402570638 |
| 2291 | 239904639 |
| 2292 | 46562128 |
| 2293 | 387151873 |
| 2294 | 297567992 |
| 2295 | 401761514 |
| 2296 | 401761514 |
| 2297 | 385785459 |
| 2298 | 387869382 |
| 2299 | 259906682 |
| 2300 | 85372828 |
| 2301 | 386632422 |
| 2302 | 386627502 |
| 2303 | 157159467 |
| 2304 | 157159467 |
| 2305 | 260866153 |
| 2306 | 218561636 |
| 2307 | 172056045 |
| 2308 | 347534971 |
| 2309 | 302877245 |
| 2310 | 302877245 |
| 2311 | 239825584 |
| 2312 | 400756305 |
| 2313 | 332661890 |
| 2314 | 386712343 |
| 2315 | 435852812 |
| 2316 | 435852812 |
| 2317 | 385816611 |
| 2318 | 301065125 |
| 2319 | 301065125 |
| 2320 | 385812838 |
| 2321 | 403514032 |
| 2322 | 268318562 |
| 2323 | 338202359 |
| 2324 | 385826720 |
| 2325 | 385826720 |
| 2326 | 258506995 |
| 2327 | 258506995 |
| 2328 | 296110131 |
| 2329 | 296110131 |
| 2330 | 148642060 |
| 2331 | 148642060 |
| 2332 | 148642060 |
| 2333 | 148642060 |
| 2334 | 148642060 |
| 2335 | 148642060 |
| 2336 | 397779166 |
| 2337 | 409187964 |
| 2338 | 409187964 |
| 2339 | 435850242 |
| 2340 | 435850242 |
| 2341 | 435850242 |
| 2342 | 20088899 |
| 2343 | 21226102 |
| 2344 | 88601322 |
| 2345 | 88601322 |
| 2346 | 336115651 |
| 2347 | 336115651 |
| 2348 | 336115651 |
| 2349 | 83588874 |
| 2350 | 83588874 |
| 2351 | 304319677 |
| 2352 | 403056439 |
| 2353 | 403056439 |
| 2354 | 118578449 |
| 2355 | 194335182 |
| 2356 | 91790731 |
| 2357 | 330806657 |
| 2358 | 392419087 |
| 2359 | 392419087 |
| 2360 | 93004831 |
| 2361 | 226303489 |
| 2362 | 192288433 |
| 2363 | 90019649 |
| 2364 | 378448274 |
| 2365 | 383494824 |
| 2366 | 16763390 |
| 2367 | 378697983 |
| 2368 | 379699217 |
| 2369 | 378982542 |
| 2370 | 378987404 |
| 2371 | 330837866 |
| 2372 | 117918459 |
| 2373 | 113968346 |
| 2374 | 257062754 |
| 2375 | 257062754 |
| 2376 | 284034943 |
| 2377 | 313681130 |
| 2378 | 313681130 |
| 2379 | 427711179 |
| 2380 | 427711179 |
| 2381 | 114565576 |
| 2382 | 114565576 |
| 2383 | 114565576 |
| 2384 | 114565576 |
| 2385 | 114565576 |
| 2386 | 114565576 |
| 2387 | 85857845 |
| 2388 | 438000910 |
| 2389 | 438000910 |
| 2390 | 332798023 |
| 2391 | 237653092 |
| 2392 | 409131816 |
| 2393 | 304315537 |
| 2394 | 390948458 |
| 2395 | 431932943 |
| 2396 | 431932943 |
| 2397 | 229606122 |
| 2398 | 360034408 |
| 2399 | 260752245 |
| 2400 | 83309099 |
| 2401 | 120552944 |
| 2402 | 186680550 |
| 2403 | 146279170 |
| 2404 | 338209545 |
| 2405 | 257051090 |
| 2406 | 169237353 |
| 2407 | 344209485 |
| 2408 | 344209485 |
| 2409 | 345006827 |
| 2410 | 433593057 |
| 2411 | 433593057 |
| 2412 | 296120274 |
| 2413 | 220915123 |
| 2414 | 262193326 |
| 2415 | 262193326 |
| 2416 | 83718394 |

TABLE 17-continued

SEQ ID NO. vs. Accession Number Index

| SEQ ID NO. | Accession No. |
|---|---|
| 2417 | 257091663 |
| 2418 | 383452024 |
| 2419 | 340792956 |
| 2420 | 86738724 |
| 2421 | 312193897 |
| 2422 | 262193326 |
| 2423 | 336115651 |
| 2424 | 302864508 |
| 2425 | 145220606 |
| 2426 | 379706264 |
| 2427 | 121582711 |
| 2428 | 121582711 |
| 2429 | 257054089 |
| 2430 | 134096620 |
| 2431 | 433601838 |
| 2432 | 430741030 |
| 2433 | 162448269 |
| 2434 | 32141095 |
| 2435 | 182433793 |
| 2436 | 72160406 |
| 2437 | 296267998 |
| 2438 | 83642913 |
| 2439 | 396584758 |
| 2440 | 452732384 |
| 2441 | 472443541 |
| 2442 | 336440820 |
| 2443 | 476380507 |
| 2444 | 374627927 |
| 2445 | 424979852 |
| 2446 | 472222746 |
| 2447 | 419173668 |
| 2448 | 331640257 |
| 2449 | 375004550 |
| 2450 | 421082290 |
| 2451 | 417605122 |
| 2452 | 417605122 |
| 2453 | 332655353 |
| 2454 | 373485774 |
| 2455 | 417268567 |
| 2456 | 363900611 |
| 2457 | 419280801 |
| 2458 | 419280801 |
| 2459 | 262371200 |
| 2460 | 256402721 |
| 2461 | 262374339 |
| 2462 | 418024796 |
| 2463 | 472199351 |
| 2464 | 419235449 |
| 2465 | 419235449 |
| 2466 | 455877139 |
| 2467 | 407801688 |
| 2468 | 424026168 |
| 2469 | 443537933 |
| 2470 | 329896015 |
| 2471 | 433118449 |
| 2472 | 313151045 |
| 2473 | 470894026 |
| 2474 | 420093456 |
| 2475 | 443474995 |
| 2476 | 423730148 |
| 2477 | 452301294 |
| 2478 | 452281584 |
| 2479 | 320096521 |
| 2480 | 373114969 |
| 2481 | 421857666 |
| 2482 | 422905795 |
| 2483 | 421735395 |
| 2484 | 293373625 |
| 2485 | 424001199 |
| 2486 | 410105720 |
| 2487 | 301030692 |
| 2488 | 319430354 |
| 2489 | 472217717 |
| 2490 | 423286106 |
| 2491 | 425019536 |
| 2492 | 238756169 |
| 2493 | 398800292 |
| 2494 | 433099189 |
| 2495 | 452722814 |
| 2496 | 419389168 |
| 2497 | 419389168 |
| 2498 | 242362072 |
| 2499 | 422028620 |
| 2500 | 442594974 |
| 2501 | 407974869 |
| 2502 | 476381541 |
| 2503 | 452704090 |
| 2504 | 452743095 |
| 2505 | 452743095 |
| 2506 | 425034026 |
| 2507 | 254426770 |
| 2508 | 424005355 |
| 2509 | 418354477 |
| 2510 | 450256199 |
| 2511 | 223955923 |
| 2512 | 419919231 |
| 2513 | 452722284 |
| 2514 | 449053971 |
| 2515 | 386289604 |
| 2516 | 411116154 |
| 2517 | 224581172 |
| 2518 | 314953942 |
| 2519 | 452301765 |
| 2520 | 422033758 |
| 2521 | 422912392 |
| 2522 | 296328579 |
| 2523 | 294784664 |
| 2524 | 262377679 |
| 2525 | 262377679 |
| 2526 | 418013522 |
| 2527 | 476381295 |
| 2528 | 293611286 |
| 2529 | 423144195 |
| 2530 | 224581037 |
| 2531 | 469923807 |
| 2532 | 336420422 |
| 2533 | 237666990 |
| 2534 | 417550237 |
| 2535 | 390606126 |
| 2536 | 390606126 |
| 2537 | 254692771 |
| 2538 | 211594571 |
| 2539 | 415823418 |
| 2540 | 301064104 |
| 2541 | 425024171 |
| 2542 | 238694717 |
| 2543 | 386814329 |
| 2544 | 476381563 |
| 2545 | 295396063 |
| 2546 | 419200062 |
| 2547 | 423718272 |
| 2548 | 423926641 |
| 2549 | 424977968 |
| 2550 | 424971161 |
| 2551 | 229509077 |
| 2552 | 340358330 |
| 2553 | 424023365 |
| 2554 | 424612424 |
| 2555 | 443530314 |
| 2556 | 424605785 |
| 2557 | 357040530 |
| 2558 | 455967306 |
| 2559 | 425047878 |
| 2560 | 149189552 |
| 2561 | 385881638 |
| 2562 | 427597607 |
| 2563 | 389575461 |
| 2564 | 442610050 |
| 2565 | 182624174 |
| 2566 | 314994688 |

TABLE 17-continued

SEQ ID NO. vs. Accession Number Index

| SEQ ID NO. | Accession No. |
|---|---|
| 2567 | 211595724 |
| 2568 | 419887425 |
| 2569 | 472214599 |
| 2570 | 422901577 |
| 2571 | 406351917 |
| 2572 | 225001047 |
| 2573 | 419281346 |
| 2574 | 356907979 |
| 2575 | 419206516 |
| 2576 | 440708760 |
| 2577 | 424651801 |
| 2578 | 472210693 |
| 2579 | 196250231 |
| 2580 | 476380904 |
| 2581 | 427557910 |
| 2582 | 224515124 |
| 2583 | 381395491 |
| 2584 | 422702452 |
| 2585 | 409167416 |
| 2586 | 476380862 |
| 2587 | 358069018 |
| 2588 | 421345543 |
| 2589 | 417812631 |
| 2590 | 401676751 |
| 2591 | 314998443 |
| 2592 | 421334477 |
| 2593 | 423532168 |
| 2594 | 314940712 |
| 2595 | 149113251 |
| 2596 | 422924875 |
| 2597 | 423891867 |
| 2598 | 419378419 |
| 2599 | 419378419 |
| 2600 | 427682108 |
| 2601 | 423480222 |
| 2602 | 421772441 |
| 2603 | 421772441 |
| 2604 | 448689403 |
| 2605 | 421768382 |
| 2606 | 421768382 |
| 2607 | 427621994 |
| 2608 | 343503287 |
| 2609 | 472166833 |
| 2610 | 418348058 |
| 2611 | 427575979 |
| 2612 | 419252283 |
| 2613 | 419252283 |
| 2614 | 251833313 |
| 2615 | 455819031 |
| 2616 | 424609621 |
| 2617 | 476380950 |
| 2618 | 469924283 |
| 2619 | 472149938 |
| 2620 | 417209278 |
| 2621 | 390169096 |
| 2622 | 455593728 |
| 2623 | 424644158 |
| 2624 | 452702507 |
| 2625 | 399579771 |
| 2626 | 472157757 |
| 2627 | 224581092 |
| 2628 | 427658715 |
| 2629 | 424974911 |
| 2630 | 417589425 |
| 2631 | 417589425 |
| 2632 | 419362951 |
| 2633 | 419362951 |
| 2634 | 427663999 |
| 2635 | 410618100 |
| 2636 | 419358064 |
| 2637 | 419358064 |
| 2638 | 419352509 |
| 2639 | 419352509 |
| 2640 | 417223690 |
| 2641 | 425444918 |
| 2642 | 472183758 |
| 2643 | 424655749 |
| 2644 | 334126448 |
| 2645 | 126665966 |
| 2646 | 423709466 |
| 2647 | 418008622 |
| 2648 | 418008622 |
| 2649 | 469924241 |
| 2650 | 410637153 |
| 2651 | 363898451 |
| 2652 | 363898451 |
| 2653 | 472152144 |
| 2654 | 419240736 |
| 2655 | 419240736 |
| 2656 | 419383938 |
| 2657 | 419383938 |
| 2658 | 424630728 |
| 2659 | 374627936 |
| 2660 | 374627936 |
| 2661 | 374627936 |
| 2662 | 418342894 |
| 2663 | 420088308 |
| 2664 | 255743719 |
| 2665 | 455929923 |
| 2666 | 206975561 |
| 2667 | 423164021 |
| 2668 | 417522340 |
| 2669 | 417522340 |
| 2670 | 419831962 |
| 2671 | 139439021 |
| 2672 | 139439021 |
| 2673 | 314944229 |
| 2674 | 423147095 |
| 2675 | 224485442 |
| 2676 | 422305960 |
| 2677 | 225363921 |
| 2678 | 417815500 |
| 2679 | 425040990 |
| 2680 | 343177620 |
| 2681 | 423878932 |
| 2682 | 211593993 |
| 2683 | 418398711 |
| 2684 | 378759082 |
| 2685 | 402296507 |
| 2686 | 259048327 |
| 2687 | 455905617 |
| 2688 | 224514842 |
| 2689 | 357631901 |
| 2690 | 384096966 |
| 2691 | 425069205 |
| 2692 | 265756999 |
| 2693 | 427646214 |
| 2694 | 403955718 |
| 2695 | 373471569 |
| 2696 | 456039135 |
| 2697 | 224993695 |
| 2698 | 149109670 |
| 2699 | 365096837 |
| 2700 | 298527635 |
| 2701 | 395208219 |
| 2702 | 419246266 |
| 2703 | 423155496 |
| 2704 | 421624890 |
| 2705 | 427425534 |
| 2706 | 458913812 |
| 2707 | 417191381 |
| 2708 | 424621178 |
| 2709 | 262405036 |
| 2710 | 422890700 |
| 2711 | 419229938 |
| 2712 | 424015456 |
| 2713 | 335043876 |
| 2714 | 419894708 |
| 2715 | 472202862 |
| 2716 | 211594035 |

TABLE 17-continued

SEQ ID NO. vs. Accession Number Index

| SEQ ID NO. | Accession No. |
|---|---|
| 2717 | 424618529 |
| 2718 | 224581212 |
| 2719 | 169343945 |
| 2720 | 405982616 |
| 2721 | 405982616 |
| 2722 | 469924367 |
| 2723 | 417292897 |
| 2724 | 418336054 |
| 2725 | 423152690 |
| 2726 | 419841668 |
| 2727 | 421338374 |
| 2728 | 325917999 |
| 2729 | 365822320 |
| 2730 | 365822320 |
| 2731 | 294645413 |
| 2732 | 419367985 |
| 2733 | 419367985 |
| 2734 | 419343475 |
| 2735 | 419343475 |
| 2736 | 365833706 |
| 2737 | 448681954 |
| 2738 | 384563951 |
| 2739 | 453074660 |
| 2740 | 375098335 |
| 2741 | 359765453 |
| 2742 | 451335404 |
| 2743 | 126666487 |
| 2744 | 257461537 |
| 2745 | 440700728 |
| 2746 | 163804182 |
| 2747 | 458780588 |
| 2748 | 383824531 |
| 2749 | 224581088 |
| 2750 | 383827549 |
| 2751 | 365878943 |
| 2752 | 254173939 |
| 2753 | 149176214 |
| 2754 | 458859600 |
| 2755 | 441515884 |
| 2756 | 163719735 |
| 2757 | 381168746 |
| 2758 | 211606481 |
| 2759 | 288920043 |
| 2760 | 319947885 |
| 2761 | 2530355711 |
| 2762 | gi [*Vibrio cholerae* O1 str. 3582-05] 650306800 |
| 2763 | 650306800 |
| 2764 | 373108119 |
| 2765 | 373108120 |
| 2766 | 326402591 |
| 2767 | 326402592 |
| 2768 | 344200468 |
| 2769 | 344200470 |
| 2770 | 169786941 |
| 2771 | 407700179 |
| 2772 | 86159653 |
| 2773 | 56478402 |
| 2774 | 403571623 |
| 2775 | 374998146 |
| 2776 | 386867050 |
| 2777 | 323527068 |
| 2778 | 330816349 |
| 2779 | 313673970 |
| 2780 | 313673972 |
| 2781 | 78045163 |
| 2782 | 189500607 |
| 2783 | 374294727 |
| 2784 | 374297205 |
| 2785 | 374297212 |
| 2786 | 300856434 |
| 2787 | 302387135 |
| 2788 | 302388014 |
| 2789 | 302388025 |
| 2790 | 310658341 |
| 2791 | 339442905 |
| 2792 | 339327417 |
| 2793 | 257060035 |
| 2794 | 257060036 |
| 2795 | 270307692 |
| 2796 | 300088702 |
| 2797 | 89893423 |
| 2798 | 408420312 |
| 2799 | 256829112 |
| 2800 | 402570962 |
| 2801 | 239908250 |
| 2802 | 46580429 |
| 2803 | 387153158 |
| 2804 | 297570107 |
| 2805 | 401762037 |
| 2806 | 401762040 |
| 2807 | 385787388 |
| 2808 | 387872413 |
| 2809 | 259909433 |
| 2810 | 85375776 |
| 2811 | 386637213 |
| 2812 | 386632293 |
| 2813 | 157159784 |
| 2814 | 157159792 |
| 2815 | 260871023 |
| 2816 | 218561661 |
| 2817 | 172056358 |
| 2818 | 347535920 |
| 2819 | 302878119 |
| 2820 | 302878744 |
| 2821 | 239826790 |
| 2822 | 39997205 |
| 2823 | 332661907 |
| 2824 | 386716366 |
| 2825 | 435853813 |
| 2826 | 435853827 |
| 2827 | 385817607 |
| 2828 | 301067091 |
| 2829 | 301067093 |
| 2830 | 385813806 |
| 2831 | 403515034 |
| 2832 | 268319507 |
| 2833 | 338203661 |
| 2834 | 385828734 |
| 2835 | 385828736 |
| 2836 | 258509090 |
| 2837 | 258509092 |
| 2838 | 296110176 |
| 2839 | 296110178 |
| 2840 | 148643803 |
| 2841 | 148643804 |
| 2842 | 148643805 |
| 2843 | 148643806 |
| 2844 | 148643807 |
| 2845 | 148643808 |
| 2846 | 397780110 |
| 2847 | 410669358 |
| 2848 | 410669360 |
| 2849 | 435851525 |
| 2850 | 435851546 |
| 2851 | 435851549 |
| 2852 | 20091204 |
| 2853 | 21226258 |
| 2854 | 88602371 |
| 2855 | 88603151 |
| 2856 | 336119449 |
| 2857 | 336119450 |
| 2858 | 336119452 |
| 2859 | 83591059 |
| 2860 | 83591062 |
| 2861 | 304320701 |
| 2862 | 403059688 |
| 2863 | 403059709 |
| 2864 | 118580703 |
| 2865 | 194337069 |

TABLE 17-continued

SEQ ID NO. vs. Accession Number Index

| SEQ ID NO. | Accession No. |
|---|---|
| 2866 | 253987913 |
| 2867 | 91790846 |
| 2868 | 330807435 |
| 2869 | 392420323 |
| 2870 | 392420328 |
| 2871 | 93006432 |
| 2872 | 226306382 |
| 2873 | 192289537 |
| 2874 | 90022401 |
| 2875 | 378453460 |
| 2876 | 383499054 |
| 2877 | 16767739 |
| 2878 | 378702328 |
| 2879 | 379703732 |
| 2880 | 378987162 |
| 2881 | 378447802 |
| 2882 | 378991756 |
| 2883 | 330838576 |
| 2884 | 117920266 |
| 2885 | 113970048 |
| 2886 | 257063038 |
| 2887 | 257063039 |
| 2888 | 284039694 |
| 2889 | 313682812 |
| 2890 | 313682817 |
| 2891 | 427712018 |
| 2892 | 427712032 |
| 2893 | 114566522 |
| 2894 | 114566525 |
| 2895 | 114566528 |
| 2896 | 114567997 |
| 2897 | 114567999 |
| 2898 | 114568012 |
| 2899 | 85858747 |
| 2900 | 438001506 |
| 2901 | 438001507 |
| 2902 | 332798531 |
| 2903 | 217968749 |
| 2904 | 410668520 |
| 2905 | 304316007 |
| 2906 | 390949845 |
| 2907 | 431933018 |
| 2908 | 431933021 |
| 2909 | 229608796 |
| 2910 | 360034504 |
| 2911 | 260753606 |
| 2912 | 83311143 |
| 2913 | 120553498 |
| 2914 | 186685709 |
| 2915 | 146279745 |
| 2916 | 338213688 |
| 2917 | 336252387 |
| 2918 | 257052985 |
| 2919 | 169237551 |
| 2920 | 222476090 |
| 2921 | 222476117 |
| 2922 | 344209878 |
| 2923 | 344209881 |
| 2924 | 345007041 |
| 2925 | 433593291 |
| 2926 | 433593292 |
| 2927 | 296123319 |
| 2928 | 220916263 |
| 2929 | 262193922 |
| 2930 | 262194481 |
| 2931 | 83719870 |
| 2932 | 257094931 |
| 2933 | 383457206 |
| 2934 | 340794636 |
| 2935 | 86741640 |
| 2936 | 312199459 |
| 2937 | 262194453 |
| 2938 | 336118510 |
| 2939 | 302865793 |
| 2940 | 145223790 |
| 2941 | 379708001 |
| 2942 | 121582865 |
| 2943 | 121582883 |
| 2944 | 257054590 |
| 2945 | 134101640 |
| 2946 | 433603658 |
| 2947 | 430742884 |
| 2948 | 162455958 |
| 2949 | 32141309 |
| 2950 | 182435394 |
| 2951 | 72161128 |
| 2952 | 296269521 |
| 2953 | 83646204 |
| 2954 | 396584767 |
| 2955 | 458152050 |
| 2956 | 472443548 |
| 2957 | 336440363 |
| 2958 | 432379519 |
| 2959 | 374625981 |
| 2960 | 424979860 |
| 2961 | 472222756 |
| 2962 | 419173671 |
| 2963 | 331001734 |
| 2964 | 375004438 |
| 2965 | 421082305 |
| 2966 | 417605261 |
| 2967 | 417605262 |
| 2968 | 332655413 |
| 2969 | 373485789 |
| 2970 | 417268711 |
| 2971 | 363899394 |
| 2972 | 419281126 |
| 2973 | 419281127 |
| 2974 | 262371246 |
| 2975 | 260887938 |
| 2976 | 262374466 |
| 2977 | 418024983 |
| 2978 | 472199361 |
| 2979 | 419235607 |
| 2980 | 419235615 |
| 2981 | 443510725 |
| 2982 | 407801760 |
| 2983 | 424026178 |
| 2984 | 443537946 |
| 2985 | 329896081 |
| 2986 | 433118459 |
| 2987 | 307287301 |
| 2988 | 470894100 |
| 2989 | 420093470 |
| 2990 | 443475017 |
| 2991 | 423730159 |
| 2992 | 458790582 |
| 2993 | 458059909 |
| 2994 | 320095082 |
| 2995 | 373113618 |
| 2996 | 421857674 |
| 2997 | 422905805 |
| 2998 | 421735407 |
| 2999 | 293373688 |
| 3000 | 424001209 |
| 3001 | 410103028 |
| 3002 | 301024306 |
| 3003 | 317501020 |
| 3004 | 472217727 |
| 3005 | 423288073 |
| 3006 | 425019540 |
| 3007 | 238756192 |
| 3008 | 398800472 |
| 3009 | 433099193 |
| 3010 | 457927367 |
| 3011 | 419389184 |
| 3012 | 419389185 |
| 3013 | 229814944 |
| 3014 | 422028736 |
| 3015 | 442594981 |

TABLE 17-continued

SEQ ID NO. vs. Accession Number Index

| SEQ ID NO. | Accession No. |
|---|---|
| 3016 | 407974987 |
| 3017 | 432983128 |
| 3018 | 457996555 |
| 3019 | 481041219 |
| 3020 | 481041220 |
| 3021 | 425034030 |
| 3022 | 254429762 |
| 3023 | 424005365 |
| 3024 | 418354534 |
| 3025 | 450256207 |
| 3026 | 313140120 |
| 3027 | 419919259 |
| 3028 | 458765351 |
| 3029 | 449054085 |
| 3030 | 386288262 |
| 3031 | 366164459 |
| 3032 | 317058270 |
| 3033 | 314950594 |
| 3034 | 458013692 |
| 3035 | 422033787 |
| 3036 | 422912401 |
| 3037 | 296328621 |
| 3038 | 294785585 |
| 3039 | 262377714 |
| 3040 | 262377715 |
| 3041 | 418013528 |
| 3042 | 432708024 |
| 3043 | 293611307 |
| 3044 | 423144204 |
| 3045 | 223986437 |
| 3046 | 430834454 |
| 3047 | 336418211 |
| 3048 | 237668455 |
| 3049 | 417550745 |
| 3050 | 388258089 |
| 3051 | 388258091 |
| 3052 | 257438025 |
| 3053 | 114706330 |
| 3054 | 415823687 |
| 3055 | 301064133 |
| 3056 | 425024179 |
| 3057 | 227889977 |
| 3058 | 386818316 |
| 3059 | 432993618 |
| 3060 | 295396110 |
| 3061 | 419200148 |
| 3062 | 423719994 |
| 3063 | 423926651 |
| 3064 | 424977972 |
| 3065 | 424971165 |
| 3066 | 229509124 |
| 3067 | 340357066 |
| 3068 | 424023374 |
| 3069 | 424612434 |
| 3070 | 443530597 |
| 3071 | 424605795 |
| 3072 | 357040626 |
| 3073 | 443522968 |
| 3074 | 425047889 |
| 3075 | 149189595 |
| 3076 | 386775209 |
| 3077 | 427597639 |
| 3078 | 389577850 |
| 3079 | 442610062 |
| 3080 | 182624175 |
| 3081 | 314992448 |
| 3082 | 153821428 |
| 3083 | 419887466 |
| 3084 | 472214608 |
| 3085 | 422901581 |
| 3086 | 404368578 |
| 3087 | 86139885 |
| 3088 | 419281500 |
| 3089 | 357010161 |
| 3090 | 419206658 |
| 3091 | 440708895 |
| 3092 | 424651811 |
| 3093 | 472210702 |
| 3094 | 196250356 |
| 3095 | 432551903 |
| 3096 | 427557940 |
| 3097 | 210635262 |
| 3098 | 381395619 |
| 3099 | 422702474 |
| 3100 | 409203049 |
| 3101 | 432531964 |
| 3102 | 358066713 |
| 3103 | 421345553 |
| 3104 | 417812643 |
| 3105 | 401676816 |
| 3106 | 314996686 |
| 3107 | 421334491 |
| 3108 | 423535443 |
| 3109 | 314939178 |
| 3110 | 167991283 |
| 3111 | 422924885 |
| 3112 | 423891877 |
| 3113 | 419378580 |
| 3114 | 419378581 |
| 3115 | 427682139 |
| 3116 | 423480950 |
| 3117 | 421772574 |
| 3118 | 421772576 |
| 3119 | 448689855 |
| 3120 | 421768508 |
| 3121 | 421768510 |
| 3122 | 427622023 |
| 3123 | 343503400 |
| 3124 | 472166843 |
| 3125 | 418348069 |
| 3126 | 427576008 |
| 3127 | 419252315 |
| 3128 | 419252316 |
| 3129 | 227544816 |
| 3130 | 443506620 |
| 3131 | 424609630 |
| 3132 | 432566737 |
| 3133 | 431640909 |
| 3134 | 472149948 |
| 3135 | 417209346 |
| 3136 | 390169174 |
| 3137 | 443502705 |
| 3138 | 424644168 |
| 3139 | 458688572 |
| 3140 | 404330918 |
| 3141 | 472157767 |
| 3142 | 302520232 |
| 3143 | 427658744 |
| 3144 | 424974919 |
| 3145 | 417589499 |
| 3146 | 417589500 |
| 3147 | 419363096 |
| 3148 | 419363097 |
| 3149 | 427664028 |
| 3150 | 410618145 |
| 3151 | 419358134 |
| 3152 | 419358135 |
| 3153 | 419352604 |
| 3154 | 419352606 |
| 3155 | 417225276 |
| 3156 | 425444983 |
| 3157 | 472183767 |
| 3158 | 424655759 |
| 3159 | 334125672 |
| 3160 | 126665993 |
| 3161 | 423709628 |
| 3162 | 418008628 |
| 3163 | 418008630 |
| 3164 | 431534714 |
| 3165 | 410637165 |

TABLE 17-continued

SEQ ID NO. vs. Accession Number Index

| SEQ ID NO. | Accession No. |
|---|---|
| 3166 | 363897440 |
| 3167 | 363897442 |
| 3168 | 472152153 |
| 3169 | 419240869 |
| 3170 | 419240870 |
| 3171 | 419383942 |
| 3172 | 419383943 |
| 3173 | 424630789 |
| 3174 | 374629424 |
| 3175 | 374629428 |
| 3176 | 374630017 |
| 3177 | 418342903 |
| 3178 | 420088374 |
| 3179 | 255743728 |
| 3180 | 443518101 |
| 3181 | 206975739 |
| 3182 | 423164025 |
| 3183 | 417522343 |
| 3184 | 417522344 |
| 3185 | 419832017 |
| 3186 | 139439066 |
| 3187 | 139439068 |
| 3188 | 314941482 |
| 3189 | 423147140 |
| 3190 | 255014566 |
| 3191 | 422306082 |
| 3192 | 254850931 |
| 3193 | 417815512 |
| 3194 | 425040994 |
| 3195 | 340752707 |
| 3196 | 423878987 |
| 3197 | 90418996 |
| 3198 | 418398867 |
| 3199 | 381199748 |
| 3200 | 402700382 |
| 3201 | 260101567 |
| 3202 | 443514287 |
| 3203 | 160944228 |
| 3204 | 358012807 |
| 3205 | 383114788 |
| 3206 | 425069878 |
| 3207 | 265757018 |
| 3208 | 427646243 |
| 3209 | 404399331 |
| 3210 | 373469126 |
| 3211 | 443534359 |
| 3212 | 225374525 |
| 3213 | 167551251 |
| 3214 | 365096846 |
| 3215 | 298528555 |
| 3216 | 395208247 |
| 3217 | 419246581 |
| 3218 | 423155505 |
| 3219 | 421624892 |
| 3220 | 427425611 |
| 3221 | 458913827 |
| 3222 | 417191518 |
| 3223 | 424621188 |
| 3224 | 262405138 |
| 3225 | 422890704 |
| 3226 | 419230120 |
| 3227 | 424015511 |
| 3228 | 335043946 |
| 3229 | 419894756 |
| 3230 | 472202872 |
| 3231 | 89073841 |
| 3232 | 424618574 |
| 3233 | 237744596 |
| 3234 | 169343972 |
| 3235 | 405982584 |
| 3236 | 405982585 |
| 3237 | 431753902 |
| 3238 | 417293087 |
| 3239 | 418336067 |
| 3240 | 423152699 |
| 3241 | 419841801 |
| 3242 | 421338421 |
| 3243 | 325918006 |
| 3244 | 366087499 |
| 3245 | 366087501 |
| 3246 | 294645435 |
| 3247 | 419368110 |
| 3248 | 419368121 |
| 3249 | 419343544 |
| 3250 | 419343545 |
| 3251 | 365831813 |
| 3252 | 448682072 |
| 3253 | 384564490 |
| 3254 | 453074718 |
| 3255 | 375098940 |
| 3256 | 359765505 |
| 3257 | 451335436 |
| 3258 | 126666547 |
| 3259 | 291003192 |
| 3260 | 440700766 |
| 3261 | 168697902 |
| 3262 | 458780601 |
| 3263 | 383824739 |
| 3264 | 238063211 |
| 3265 | 383828987 |
| 3266 | 365878961 |
| 3267 | 257140680 |
| 3268 | 149176311 |
| 3269 | 458859651 |
| 3270 | 441515889 |
| 3271 | 254821510 |
| 3272 | 381168763 |
| 3273 | 88810586 |
| 3274 | 288920049 |
| 3275 | 319947886 |
| 3276 | 2530355711 |
| 3277 | 458067973 |
| 3278 | 650306800 |
| 3279 | 373106086 |
| 3280 | 373106628 |
| 3281 | 239904639 |
| 3282 | 640526656 |
| 3283 | 302390797 |
| 3284 | 117927211 |
| 3285 | 392406391 |
| 3286 | 150002608 |
| 3287 | 312792283 |
| 3288 | 219846956 |
| 3289 | 219846956 |
| 3290 | 317151727 |
| 3291 | 146328629 |
| 3292 | 289191496 |
| 3293 | 336475959 |
| 3294 | 336475959 |
| 3295 | 189218017 |
| 3296 | 189218017 |
| 3297 | 83588874 |
| 3298 | 77163561 |
| 3299 | 300112745 |
| 3300 | 154250456 |
| 3301 | 154250456 |
| 3302 | 325106586 |
| 3303 | 297616214 |
| 3304 | 438000910 |
| 3305 | 332798023 |
| 3306 | 269791619 |
| 3307 | 320114857 |
| 3308 | 289577265 |
| 3309 | 167036431 |
| 3310 | 390933132 |
| 3311 | 433653743 |
| 3312 | 333895862 |
| 3313 | 386810750 |
| 3314 | 196035064 |
| 3315 | 419725778 |

TABLE 17-continued

SEQ ID NO. vs. Accession Number Index

| SEQ ID NO. | Accession No. |
|---|---|
| 3316 | 336430981 |
| 3317 | 336430981 |
| 3318 | 242355593 |
| 3319 | 397905651 |
| 3320 | 397905651 |
| 3321 | 397905651 |
| 3322 | 397905651 |
| 3323 | 390993910 |
| 3324 | 323701113 |
| 3325 | 288572734 |
| 3326 | 325672510 |
| 3327 | 408373871 |
| 3328 | 423394306 |
| 3329 | 254434980 |
| 3330 | 334130722 |
| 3331 | 472439485 |
| 3332 | 398888999 |
| 3333 | 196044104 |
| 3334 | 374534854 |
| 3335 | 415887008 |
| 3336 | 343509531 |
| 3337 | 381156824 |
| 3338 | 374623705 |
| 3339 | 326204471 |
| 3340 | 326389902 |
| 3341 | 256752440 |
| 3342 | 211606481 |
| 3343 | 302392143 |
| 3344 | 117928022 |
| 3345 | 392408178 |
| 3346 | 150006231 |
| 3347 | 312792858 |
| 3348 | 219848032 |
| 3349 | 219848035 |
| 3350 | 317153366 |
| 3351 | 146329329 |
| 3352 | 289192376 |
| 3353 | 336477234 |
| 3354 | 336477237 |
| 3355 | 189218335 |
| 3356 | 189218340 |
| 3357 | 83589501 |
| 3358 | 77163606 |
| 3359 | 300112784 |
| 3360 | 154251631 |
| 3361 | 154253989 |
| 3362 | 325107710 |
| 3363 | 297617451 |
| 3364 | 438003072 |
| 3365 | 332799808 |
| 3366 | 269793097 |
| 3367 | 320115756 |
| 3368 | 289578544 |
| 3369 | 167037340 |
| 3370 | 390935376 |
| 3371 | 433655485 |
| 3372 | 333896807 |
| 3373 | 386811042 |
| 3374 | 196035235 |
| 3375 | 419725843 |
| 3376 | 336426890 |
| 3377 | 336426891 |
| 3378 | 257885935 |
| 3379 | 397905667 |
| 3380 | 397905668 |
| 3381 | 397905669 |
| 3382 | 397905678 |
| 3383 | 392538884 |
| 3384 | 323701235 |
| 3385 | 288575100 |
| 3386 | 325266724 |
| 3387 | 408373941 |
| 3388 | 423398558 |
| 3389 | 254435024 |
| 3390 | 334130735 |
| 3391 | 472439492 |
| 3392 | 398889058 |
| 3393 | 196044173 |
| 3394 | 374812242 |
| 3395 | 415887048 |
| 3396 | 343509539 |
| 3397 | 381156864 |
| 3398 | 374623709 |
| 3399 | 326204499 |
| 3400 | 326389941 |
| 3401 | 256752456 |
| 3402 | 88811247 |
| 3403 | 640526656 |
| 3404 | 385785459 |
| 3405 | 385785459 |
| 3406 | 387869382 |
| 3407 | 387869382 |
| 3408 | 259906682 |
| 3409 | 259906682 |
| 3410 | 432327926 |
| 3411 | 392406391 |
| 3412 | 392406391 |
| 3413 | 169830219 |
| 3414 | 206895078 |
| 3415 | 206895078 |
| 3416 | 428771848 |
| 3417 | 291285947 |
| 3418 | 431792069 |
| 3419 | 253698656 |
| 3420 | 327312315 |
| 3421 | 148269145 |
| 3422 | 385787366 |
| 3423 | 385787369 |
| 3424 | 387872430 |
| 3425 | 387872433 |
| 3426 | 259909452 |
| 3427 | 259909455 |
| 3428 | 432329235 |
| 3429 | 392407896 |
| 3430 | 392407897 |
| 3431 | 169830967 |
| 3432 | 206895424 |
| 3433 | 206895920 |
| 3434 | 428774403 |
| 3435 | 291286509 |
| 3436 | 431792781 |
| 3437 | 253699433 |
| 3438 | 327312660 |
| 3439 | 148270868 |
| 3440 | 374629450 |
| 3441 | 640526657 |
| 3442 | uid68105 |
| 3443 | uid58807 |
| 3444 | 300087139 |
| 3445 | 239904639 |
| 3446 | 239825584 |
| 3447 | 386712343 |
| 3448 | 237653092 |
| 3449 | 257051090 |
| 3450 | 344209485 |
| 3451 | 345006827 |
| 3452 | 433593057 |
| 3453 | 117927211 |
| 3454 | 392406391 |
| 3455 | 150002608 |
| 3456 | 219846956 |
| 3457 | 317151727 |
| 3458 | 146328629 |
| 3459 | 336475959 |
| 3460 | 189218017 |
| 3461 | 83588874 |
| 3462 | 77163561 |
| 3463 | 300112745 |
| 3464 | 154250456 |
| 3465 | 154250456 |

TABLE 17-continued

SEQ ID NO. vs. Accession Number Index

| SEQ ID NO. | Accession No. |
|---|---|
| 3466 | 325106586 |
| 3467 | 269791619 |
| 3468 | 320114857 |
| 3469 | 167036431 |
| 3470 | 390933132 |
| 3471 | 433653743 |
| 3472 | 333895862 |
| 3473 | 72160406 |
| 3474 | 196250231 |
| 3475 | 126665966 |
| 3476 | 448302553 |
| 3477 | 448681954 |
| 3478 | 448413196 |
| 3479 | 386810750 |
| 3480 | 196035064 |
| 3481 | 419725778 |
| 3482 | 336430981 |
| 3483 | 397905651 |
| 3484 | 390993910 |
| 3485 | 408373871 |
| 3486 | 334130722 |
| 3487 | 374534854 |
| 3488 | 343509531 |
| 3489 | 374623705 |
| 3490 | 326204471 |
| 3491 | 326389902 |
| 3492 | 300088690 |
| 3493 | 640526657 |
| 3494 | 239908234 |
| 3495 | 239826792 |
| 3496 | 386716364 |
| 3497 | 217968742 |
| 3498 | 336252392 |
| 3499 | 257052989 |
| 3500 | 222476088 |
| 3501 | 344209877 |
| 3502 | 345007044 |
| 3503 | 433593295 |
| 3504 | 117928024 |
| 3505 | 392408176 |
| 3506 | 150006233 |
| 3507 | 219848036 |
| 3508 | 317153368 |
| 3509 | 146329165 |
| 3510 | 336477230 |
| 3511 | 189218338 |
| 3512 | 83589502 |
| 3513 | 77163610 |
| 3514 | 300112788 |
| 3515 | 154251630 |
| 3516 | 154253990 |
| 3517 | 325107709 |
| 3518 | 269793095 |
| 3519 | 320115757 |
| 3520 | 167037341 |
| 3521 | 390935375 |
| 3522 | 433655484 |
| 3523 | 333896808 |
| 3524 | 72161129 |
| 3525 | 196250353 |
| 3526 | 126665998 |
| 3527 | 448302575 |
| 3528 | 448682070 |
| 3529 | 448413225 |
| 3530 | 386811038 |
| 3531 | 196035256 |
| 3532 | 419725842 |
| 3533 | 336426889 |
| 3534 | 397905670 |
| 3535 | 392538883 |
| 3536 | 408373939 |
| 3537 | 334130734 |
| 3538 | 374812236 |
| 3539 | 343509538 |
| 3540 | 374623707 |
| 3541 | 326204500 |
| 3542 | 326389940 |
| 3543 | 89892746 |
| 3544 | 89892746 |
| 3545 | 89892746 |
| 3546 | 257091663 |
| 3547 | 383452024 |
| 3548 | 340792956 |
| 3549 | 86738724 |
| 3550 | 312193897 |
| 3551 | 262193326 |
| 3552 | 336115651 |
| 3553 | 302864508 |
| 3554 | 145220606 |
| 3555 | 379706264 |
| 3556 | 121582711 |
| 3557 | 257054089 |
| 3558 | 134096620 |
| 3559 | 433601838 |
| 3560 | 430741030 |
| 3561 | 162448269 |
| 3562 | 32141095 |
| 3563 | 182433793 |
| 3564 | 72160406 |
| 3565 | 83642913 |
| 3566 | 296120274 |
| 3567 | 220915123 |
| 3568 | 262193326 |
| 3569 | 262193326 |
| 3570 | 384563951 |
| 3571 | 453074660 |
| 3572 | 375098335 |
| 3573 | 359765453 |
| 3574 | 451335404 |
| 3575 | 126666487 |
| 3576 | 470888868 |
| 3577 | 443475057 |
| 3578 | 440700728 |
| 3579 | 163804182 |
| 3580 | 458780588 |
| 3581 | 383824531 |
| 3582 | 224581088 |
| 3583 | 383827549 |
| 3584 | 365878943 |
| 3585 | 149176214 |
| 3586 | 458859600 |
| 3587 | 441515884 |
| 3588 | 381168746 |
| 3589 | 211606481 |
| 3590 | 288920043 |
| 3591 | 452746574 |
| 3592 | 319947885 |
| 3593 | 89893418 |
| 3594 | 89893419 |
| 3595 | 89893420 |
| 3596 | 257094923 |
| 3597 | 383457201 |
| 3598 | 340794640 |
| 3599 | 86741644 |
| 3600 | 312199463 |
| 3601 | 262194457 |
| 3602 | 336118506 |
| 3603 | 302865799 |
| 3604 | 145223786 |
| 3605 | 379707997 |
| 3606 | 121582859 |
| 3607 | 257054594 |
| 3608 | 134101636 |
| 3609 | 433603650 |
| 3610 | 430742878 |
| 3611 | 162455969 |
| 3612 | 21224937 |
| 3613 | 182435404 |
| 3614 | 72161116 |
| 3615 | 83646200 |

TABLE 17-continued

SEQ ID NO. vs. Accession Number Index

| SEQ ID NO. | Accession No. |
|---|---|
| 3616 | 384564494 |
| 3617 | 453074725 |
| 3618 | 375098944 |
| 3619 | 359765509 |
| 3620 | 451335431 |
| 3621 | 126666534 |
| 3622 | 296123316 |
| 3623 | 220916267 |
| 3624 | 262193925 |
| 3625 | 262194484 |
| 3626 | 470888962 |
| 3627 | 443475062 |
| 3628 | 440700770 |
| 3629 | 168697896 |
| 3630 | 458780593 |
| 3631 | 383824743 |
| 3632 | 238063224 |
| 3633 | 383828983 |
| 3634 | 365878957 |
| 3635 | 149176307 |
| 3636 | 458859665 |
| 3637 | 441515893 |
| 3638 | 381168769 |
| 3639 | 88810592 |
| 3640 | 288920053 |
| 3641 | 452746646 |
| 3642 | 319947890 |
| 3643 | 643625576 |
| 3644 | 378443454 |
| 3645 | 649671144 |
| 3646 | 326402148 |
| 3647 | 344198243 |
| 3648 | 169786889 |
| 3649 | 86156430 |
| 3650 | 56475432 |
| 3651 | 146351220 |
| 3652 | 374998023 |
| 3653 | 386866198 |
| 3654 | 410470815 |
| 3655 | 323524377 |
| 3656 | 330814956 |
| 3657 | 134294128 |
| 3658 | 313671969 |
| 3659 | 78042616 |
| 3660 | 189499000 |
| 3661 | 374294493 |
| 3662 | 374294493 |
| 3663 | 300853232 |
| 3664 | 302384444 |
| 3665 | 302384444 |
| 3666 | 339441064 |
| 3667 | 339324158 |
| 3668 | 257057919 |
| 3669 | 270307451 |
| 3670 | 300087139 |
| 3671 | 89892746 |
| 3672 | 408417460 |
| 3673 | 256827818 |
| 3674 | 402570638 |
| 3675 | 239904639 |
| 3676 | 46562128 |
| 3677 | 387151873 |
| 3678 | 297567992 |
| 3679 | 401761514 |
| 3680 | 385785459 |
| 3681 | 387869382 |
| 3682 | 259906682 |
| 3683 | 85372828 |
| 3684 | 386632422 |
| 3685 | 386627502 |
| 3686 | 157159467 |
| 3687 | 260866153 |
| 3688 | 218561636 |
| 3689 | 172056045 |
| 3690 | 347534971 |
| 3691 | 302877245 |
| 3692 | 302877245 |
| 3693 | 400756305 |
| 3694 | 332661890 |
| 3695 | 397655102 |
| 3696 | 301065125 |
| 3697 | 385826720 |
| 3698 | 258506995 |
| 3699 | 296110131 |
| 3700 | 397779166 |
| 3701 | 409187964 |
| 3702 | 435850242 |
| 3703 | 20088899 |
| 3704 | 21226102 |
| 3705 | 88601322 |
| 3706 | 88601322 |
| 3707 | 336115651 |
| 3708 | 83588874 |
| 3709 | 304319677 |
| 3710 | 403056439 |
| 3711 | 118578449 |
| 3712 | 194335182 |
| 3713 | 91790731 |
| 3714 | 330806657 |
| 3715 | 392419087 |
| 3716 | 226303489 |
| 3717 | 192288433 |
| 3718 | 90019649 |
| 3719 | 378448274 |
| 3720 | 383494824 |
| 3721 | 16763390 |
| 3722 | 378697983 |
| 3723 | 379699217 |
| 3724 | 378982542 |
| 3725 | 378987404 |
| 3726 | 257062754 |
| 3727 | 284034943 |
| 3728 | 313681130 |
| 3729 | 427711179 |
| 3730 | 114565576 |
| 3731 | 114565576 |
| 3732 | 85857845 |
| 3733 | 438000910 |
| 3734 | 332798023 |
| 3735 | 237653092 |
| 3736 | 409131816 |
| 3737 | 304315537 |
| 3738 | 431932943 |
| 3739 | 229606122 |
| 3740 | 360034408 |
| 3741 | 260752245 |
| 3742 | 83309099 |
| 3743 | 120552944 |
| 3744 | 186680550 |
| 3745 | 146279170 |
| 3746 | 338209545 |
| 3747 | 432327926 |
| 3748 | 392406391 |
| 3749 | 169830219 |
| 3750 | 206895078 |
| 3751 | 428771848 |
| 3752 | 291285947 |
| 3753 | 431792069 |
| 3754 | 253698656 |
| 3755 | 327312315 |
| 3756 | 148269145 |
| 3757 | 396584758 |
| 3758 | 452732384 |
| 3759 | 472443541 |
| 3760 | 476380507 |
| 3761 | 374627927 |
| 3762 | 424979852 |
| 3763 | 472222746 |
| 3764 | 419173668 |
| 3765 | 375004550 |

TABLE 17-continued

SEQ ID NO. vs. Accession Number Index

| SEQ ID NO. | Accession No. |
|---|---|
| 3766 | 421082290 |
| 3767 | 417605122 |
| 3768 | 332655353 |
| 3769 | 373485774 |
| 3770 | 417268567 |
| 3771 | 363900611 |
| 3772 | 419280801 |
| 3773 | 262371200 |
| 3774 | 262374339 |
| 3775 | 418024796 |
| 3776 | 472199351 |
| 3777 | 419235449 |
| 3778 | 352101099 |
| 3779 | 226597601 |
| 3780 | 455877139 |
| 3781 | 407801688 |
| 3782 | 424026168 |
| 3783 | 443537933 |
| 3784 | 329896015 |
| 3785 | 433118449 |
| 3786 | 313151045 |
| 3787 | 470894026 |
| 3788 | 420093456 |
| 3789 | 443474995 |
| 3790 | 423730148 |
| 3791 | 452301294 |
| 3792 | 452281584 |
| 3793 | 320096521 |
| 3794 | 421857666 |
| 3795 | 422905795 |
| 3796 | 421735395 |
| 3797 | 293373625 |
| 3798 | 424001199 |
| 3799 | 410105720 |
| 3800 | 301030692 |
| 3801 | 472217717 |
| 3802 | 423286106 |
| 3803 | 238756169 |
| 3804 | 398800292 |
| 3805 | 433099189 |
| 3806 | 452722814 |
| 3807 | 419389168 |
| 3808 | 242362072 |
| 3809 | 422028620 |
| 3810 | 442594974 |
| 3811 | 407974869 |
| 3812 | 476381541 |
| 3813 | 452704090 |
| 3814 | 452743095 |
| 3815 | 425034026 |
| 3816 | 254426770 |
| 3817 | 424005355 |
| 3818 | 418354477 |
| 3819 | 450256199 |
| 3820 | 223955923 |
| 3821 | 419919231 |
| 3822 | 452722284 |
| 3823 | 449053971 |
| 3824 | 386289604 |
| 3825 | 359780050 |
| 3826 | 411116154 |
| 3827 | 314953942 |
| 3828 | 452301765 |
| 3829 | 422033758 |
| 3830 | 422912392 |
| 3831 | 296328579 |
| 3832 | 294784664 |
| 3833 | 418013522 |
| 3834 | 476381295 |
| 3835 | 293611286 |
| 3836 | 423144195 |
| 3837 | 224581037 |
| 3838 | 469923807 |
| 3839 | 336420422 |
| 3840 | 237666990 |
| 3841 | 417550237 |
| 3842 | 390606126 |
| 3843 | 254692771 |
| 3844 | 211594571 |
| 3845 | 415823418 |
| 3846 | 301064104 |
| 3847 | 425024171 |
| 3848 | 386814329 |
| 3849 | 476381563 |
| 3850 | 295396063 |
| 3851 | 419200062 |
| 3852 | 423926641 |
| 3853 | 424977968 |
| 3854 | 424971161 |
| 3855 | 229509077 |
| 3856 | 340358330 |
| 3857 | 424023365 |
| 3858 | 424612424 |
| 3859 | 443530314 |
| 3860 | 424605785 |
| 3861 | 455967306 |
| 3862 | 425047878 |
| 3863 | 149189552 |
| 3864 | 385881638 |
| 3865 | 427597607 |
| 3866 | 442610050 |
| 3867 | 182624174 |
| 3868 | 314994688 |
| 3869 | 211595724 |
| 3870 | 419887425 |
| 3871 | 472214599 |
| 3872 | 422901577 |
| 3873 | 406351917 |
| 3874 | 225001047 |
| 3875 | 419281346 |
| 3876 | 356907979 |
| 3877 | 419206516 |
| 3878 | 406839856 |
| 3879 | 440708760 |
| 3880 | 424651801 |
| 3881 | 472210693 |
| 3882 | 476380904 |
| 3883 | 427557910 |
| 3884 | 224515124 |
| 3885 | 422702452 |
| 3886 | 409167416 |
| 3887 | 476380862 |
| 3888 | 358069018 |
| 3889 | 421345543 |
| 3890 | 417812631 |
| 3891 | 401676751 |
| 3892 | 314998443 |
| 3893 | 421334477 |
| 3894 | 423532168 |
| 3895 | 314940712 |
| 3896 | 149113251 |
| 3897 | 422924875 |
| 3898 | 423891867 |
| 3899 | 419378419 |
| 3900 | 427682108 |
| 3901 | 448689403 |
| 3902 | 421768382 |
| 3903 | 427621994 |
| 3904 | 343503287 |
| 3905 | 472166833 |
| 3906 | 418348058 |
| 3907 | 427575979 |
| 3908 | 419252283 |
| 3909 | 455819031 |
| 3910 | 424609621 |
| 3911 | 476380950 |
| 3912 | 469924283 |
| 3913 | 472149938 |
| 3914 | 417209278 |
| 3915 | 390169096 |

TABLE 17-continued

SEQ ID NO. vs. Accession Number Index

| SEQ ID NO. | Accession No. |
|---|---|
| 3916 | 455593728 |
| 3917 | 424644158 |
| 3918 | 452702507 |
| 3919 | 399579771 |
| 3920 | 472157757 |
| 3921 | 224581092 |
| 3922 | 427658715 |
| 3923 | 424974911 |
| 3924 | 417589425 |
| 3925 | 294807000 |
| 3926 | 419362951 |
| 3927 | 427663999 |
| 3928 | 345651578 |
| 3929 | 373849145 |
| 3930 | 224485776 |
| 3931 | 298384183 |
| 3932 | 419358064 |
| 3933 | 419352509 |
| 3934 | 417223690 |
| 3935 | 381157709 |
| 3936 | 282900768 |
| 3937 | 472183758 |
| 3938 | 424655749 |
| 3939 | 334126448 |
| 3940 | 126665966 |
| 3941 | 423709466 |
| 3942 | 437842748 |
| 3943 | 418008622 |
| 3944 | 469924241 |
| 3945 | 410637153 |
| 3946 | 363898451 |
| 3947 | 472152144 |
| 3948 | 419240736 |
| 3949 | 419383938 |
| 3950 | 424630728 |
| 3951 | 374627936 |
| 3952 | 374627936 |
| 3953 | 418342894 |
| 3954 | 420088308 |
| 3955 | 255743719 |
| 3956 | 455929923 |
| 3957 | 206975561 |
| 3958 | 423164021 |
| 3959 | 417522340 |
| 3960 | 419831962 |
| 3961 | 139439021 |
| 3962 | 314944229 |
| 3963 | 423147095 |
| 3964 | 224485442 |
| 3965 | 422305960 |
| 3966 | 225363921 |
| 3967 | 417815500 |
| 3968 | 425040990 |
| 3969 | 343177620 |
| 3970 | 423878932 |
| 3971 | 211593993 |
| 3972 | 418398711 |
| 3973 | 378759082 |
| 3974 | 402296507 |
| 3975 | 455905617 |
| 3976 | 224514842 |
| 3977 | 357631901 |
| 3978 | 384096966 |
| 3979 | 425069205 |
| 3980 | 265756999 |
| 3981 | 427646214 |
| 3982 | 403955718 |
| 3983 | 456039135 |
| 3984 | 224993695 |
| 3985 | 149109670 |
| 3986 | 365096837 |
| 3987 | 298527635 |
| 3988 | 395208219 |
| 3989 | 458920171 |
| 3990 | 419246266 |
| 3991 | 423155496 |
| 3992 | 421624890 |
| 3993 | 427425534 |
| 3994 | 458913812 |
| 3995 | 417191381 |
| 3996 | 424621178 |
| 3997 | 262405036 |
| 3998 | 422890700 |
| 3999 | 419229938 |
| 4000 | 424015456 |
| 4001 | 335043876 |
| 4002 | 419894708 |
| 4003 | 472202862 |
| 4004 | 211594035 |
| 4005 | 424618529 |
| 4006 | 224581212 |
| 4007 | 169343945 |
| 4008 | 405982616 |
| 4009 | 469924367 |
| 4010 | 417292897 |
| 4011 | 418336054 |
| 4012 | 423152690 |
| 4013 | 421338374 |
| 4014 | 325917999 |
| 4015 | 365822320 |
| 4016 | 294645413 |
| 4017 | 419367985 |
| 4018 | 419343475 |
| 4019 | 365833706 |
| 4020 | 2530355716 |
| 4021 | 2519334105 |
| 4022 | MMU_RS00545 |
| 4023 | 646308668 |
| 4024 | 650306805 |
| 4025 | 2537201269 |
| 4026 | 373108119 |
| 4027 | 2520254729 |
| 4028 | 2530355716 |
| 4029 | 458067971 |
| 4030 | 425019542 |
| 4031 | 646308668 |
| 4032 | 650306805 |
| 4033 | 492852646 |
| 4034 | 373106088 |
| 4035 | 421772578 |
| 4036 | 396584762 |
| 4037 | 458152052 |
| 4038 | 472443553 |
| 4039 | 432379517 |
| 4040 | 374625984 |
| 4041 | 424979858 |
| 4042 | 472222758 |
| 4043 | 419173675 |
| 4044 | 375004434 |
| 4045 | 421082301 |
| 4046 | 417605259 |
| 4047 | 332655410 |
| 4048 | 373485792 |
| 4049 | 417270270 |
| 4050 | 363899391 |
| 4051 | 419281124 |
| 4052 | 262371243 |
| 4053 | 262374468 |
| 4054 | 418024985 |
| 4055 | 472199363 |
| 4056 | 419235530 |
| 4057 | 352101103 |
| 4058 | 229817508 |
| 4059 | 443510727 |
| 4060 | 407801762 |
| 4061 | 424026180 |
| 4062 | 443537948 |
| 4063 | 329896079 |
| 4064 | 433118457 |
| 4065 | 307287306 |

TABLE 17-continued

SEQ ID NO. vs. Accession Number Index

| SEQ ID NO. | Accession No. |
|---|---|
| 4066 | 470894092 |
| 4067 | 420093472 |
| 4068 | 443475014 |
| 4069 | 423730161 |
| 4070 | 458790580 |
| 4071 | 458059907 |
| 4072 | 320095086 |
| 4073 | 421857676 |
| 4074 | 422905807 |
| 4075 | 421735403 |
| 4076 | 293373678 |
| 4077 | 424001211 |
| 4078 | 410103020 |
| 4079 | 301024302 |
| 4080 | 472217729 |
| 4081 | 423288069 |
| 4082 | 238756194 |
| 4083 | 398800476 |
| 4084 | 433099191 |
| 4085 | 457927369 |
| 4086 | 419389182 |
| 4087 | 229814937 |
| 4088 | 422028732 |
| 4089 | 442594983 |
| 4090 | 407974985 |
| 4091 | 432983130 |
| 4092 | 457996557 |
| 4093 | 458890356 |
| 4094 | 425034032 |
| 4095 | 254426952 |
| 4096 | 424005367 |
| 4097 | 418354501 |
| 4098 | 450256205 |
| 4099 | 313140124 |
| 4100 | 419919255 |
| 4101 | 458765347 |
| 4102 | 449054083 |
| 4103 | 386288264 |
| 4104 | 359780187 |
| 4105 | 366164455 |
| 4106 | 314950592 |
| 4107 | 458013694 |
| 4108 | 422033783 |
| 4109 | 422912403 |
| 4110 | 296328616 |
| 4111 | 294785576 |
| 4112 | 418013524 |
| 4113 | 432708026 |
| 4114 | 293611310 |
| 4115 | 423144206 |
| 4116 | 223986435 |
| 4117 | 430834451 |
| 4118 | 336418216 |
| 4119 | 237667216 |
| 4120 | 417550931 |
| 4121 | 388258085 |
| 4122 | 257438022 |
| 4123 | 114706328 |
| 4124 | 415823685 |
| 4125 | 301064155 |
| 4126 | 425024177 |
| 4127 | 386818319 |
| 4128 | 432993620 |
| 4129 | 295396107 |
| 4130 | 419200146 |
| 4131 | 423926653 |
| 4132 | 424977974 |
| 4133 | 424971167 |
| 4134 | 229509122 |
| 4135 | 340357071 |
| 4136 | 424023376 |
| 4137 | 424612436 |
| 4138 | 443530599 |
| 4139 | 424605797 |
| 4140 | 443522970 |
| 4141 | 425047887 |
| 4142 | 149189591 |
| 4143 | 386775211 |
| 4144 | 427597635 |
| 4145 | 442610057 |
| 4146 | 182624227 |
| 4147 | 314992446 |
| 4148 | 153821414 |
| 4149 | 419887464 |
| 4150 | 472214610 |
| 4151 | 422901583 |
| 4152 | 404368580 |
| 4153 | 86139883 |
| 4154 | 419281498 |
| 4155 | 357010159 |
| 4156 | 419206621 |
| 4157 | 407366547 |
| 4158 | 440708897 |
| 4159 | 424651813 |
| 4160 | 472210704 |
| 4161 | 432551907 |
| 4162 | 427557936 |
| 4163 | 210635283 |
| 4164 | 422702479 |
| 4165 | 409203046 |
| 4166 | 432531962 |
| 4167 | 358066708 |
| 4168 | 421345651 |
| 4169 | 417812645 |
| 4170 | 401676818 |
| 4171 | 314996688 |
| 4172 | 421334493 |
| 4173 | 423535441 |
| 4174 | 314939176 |
| 4175 | 167991279 |
| 4176 | 422924887 |
| 4177 | 423891879 |
| 4178 | 419378576 |
| 4179 | 427682135 |
| 4180 | 448689852 |
| 4181 | 421768506 |
| 4182 | 427622019 |
| 4183 | 343503402 |
| 4184 | 472166845 |
| 4185 | 418348071 |
| 4186 | 427576004 |
| 4187 | 419252313 |
| 4188 | 443506622 |
| 4189 | 424609632 |
| 4190 | 432566739 |
| 4191 | 431639957 |
| 4192 | 472149950 |
| 4193 | 417209313 |
| 4194 | 390169172 |
| 4195 | 443502707 |
| 4196 | 424644170 |
| 4197 | 458688570 |
| 4198 | 404330916 |
| 4199 | 472157769 |
| 4200 | 302520230 |
| 4201 | 427658740 |
| 4202 | 424974917 |
| 4203 | 417589497 |
| 4204 | 294807065 |
| 4205 | 419363094 |
| 4206 | 427664024 |
| 4207 | 345508155 |
| 4208 | 373849342 |
| 4209 | 224023318 |
| 4210 | 298384291 |
| 4211 | 419358132 |
| 4212 | 419352602 |
| 4213 | 417225329 |
| 4214 | 381159258 |
| 4215 | 282900771 |

TABLE 17-continued

SEQ ID NO. vs. Accession Number Index

| SEQ ID NO. | Accession No. |
|---|---|
| 4216 | 472183769 |
| 4217 | 424655761 |
| 4218 | 334125676 |
| 4219 | 126665989 |
| 4220 | 423709626 |
| 4221 | 437842749 |
| 4222 | 418008626 |
| 4223 | 431534716 |
| 4224 | 410637167 |
| 4225 | 363897437 |
| 4226 | 472152155 |
| 4227 | 419240867 |
| 4228 | 419383940 |
| 4229 | 424630787 |
| 4230 | 374629422 |
| 4231 | 374630013 |
| 4232 | 418342905 |
| 4233 | 420088372 |
| 4234 | 255743730 |
| 4235 | 443518103 |
| 4236 | 206975706 |
| 4237 | 423164027 |
| 4238 | 417522341 |
| 4239 | 419832019 |
| 4240 | 139439070 |
| 4241 | 314941484 |
| 4242 | 423147138 |
| 4243 | 255014574 |
| 4244 | 422306084 |
| 4245 | 254850933 |
| 4246 | 417815514 |
| 4247 | 425040996 |
| 4248 | 340752712 |
| 4249 | 423878989 |
| 4250 | 90418994 |
| 4251 | 418398865 |
| 4252 | 381199750 |
| 4253 | 402700386 |
| 4254 | 443514289 |
| 4255 | 160944231 |
| 4256 | 358012804 |
| 4257 | 383114793 |
| 4258 | 425069880 |
| 4259 | 265757015 |
| 4260 | 427646239 |
| 4261 | 404399327 |
| 4262 | 443534361 |
| 4263 | 225374522 |
| 4264 | 167551253 |
| 4265 | 365096850 |
| 4266 | 298528551 |
| 4267 | 395208399 |
| 4268 | 458920174 |
| 4269 | 419246579 |
| 4270 | 423155507 |
| 4271 | 421624974 |
| 4272 | 427425548 |
| 4273 | 458913825 |
| 4274 | 417191569 |
| 4275 | 424621190 |
| 4276 | 262405142 |
| 4277 | 422890706 |
| 4278 | 419230118 |
| 4279 | 424015513 |
| 4280 | 335043942 |
| 4281 | 419894754 |
| 4282 | 472202874 |
| 4283 | 89073838 |
| 4284 | 424618572 |
| 4285 | 237744586 |
| 4286 | 169343977 |
| 4287 | 405982582 |
| 4288 | 431753904 |
| 4289 | 417293248 |
| 4290 | 418336069 |
| 4291 | 423152701 |
| 4292 | 421338419 |
| 4293 | 325918003 |
| 4294 | 366087497 |
| 4295 | 294645439 |
| 4296 | 419368125 |
| 4297 | 419343542 |
| 4298 | 365831817 |
| 4299 | 221635514 |
| 4300 | 326402588 |
| 4301 | 344200474 |
| 4302 | 169786938 |
| 4303 | 86159651 |
| 4304 | 56478416 |
| 4305 | 403571621 |
| 4306 | 374998143 |
| 4307 | 386867052 |
| 4308 | 410471302 |
| 4309 | 323527063 |
| 4310 | 330816351 |
| 4311 | 134296115 |
| 4312 | 313673968 |
| 4313 | 78044476 |
| 4314 | 189500605 |
| 4315 | 374294730 |
| 4316 | 374297209 |
| 4317 | 300856431 |
| 4318 | 302387131 |
| 4319 | 302388009 |
| 4320 | 310658345 |
| 4321 | 339442909 |
| 4322 | 339327414 |
| 4323 | 257060031 |
| 4324 | 270307690 |
| 4325 | 300088700 |
| 4326 | 89893426 |
| 4327 | 408420307 |
| 4328 | 256829109 |
| 4329 | 402570965 |
| 4330 | 239908247 |
| 4331 | 46580426 |
| 4332 | 387153161 |
| 4333 | 297570103 |
| 4334 | 401762035 |
| 4335 | 385787386 |
| 4336 | 387872415 |
| 4337 | 259909435 |
| 4338 | 85375778 |
| 4339 | 386637215 |
| 4340 | 386632295 |
| 4341 | 157159794 |
| 4342 | 260871021 |
| 4343 | 218561663 |
| 4344 | 172056360 |
| 4345 | 347535913 |
| 4346 | 302878128 |
| 4347 | 302878746 |
| 4348 | 39997203 |
| 4349 | 332661903 |
| 4350 | 397655644 |
| 4351 | 301067089 |
| 4352 | 385828732 |
| 4353 | 258509088 |
| 4354 | 296110174 |
| 4355 | 397780108 |
| 4356 | 410669364 |
| 4357 | 435851538 |
| 4358 | 20091197 |
| 4359 | 21226266 |
| 4360 | 88602367 |
| 4361 | 88603160 |
| 4362 | 336119455 |
| 4363 | 83591057 |
| 4364 | 304320699 |
| 4365 | 403059711 |

TABLE 17-continued

SEQ ID NO. vs. Accession Number Index

| SEQ ID NO. | Accession No. |
|---|---|
| 4366 | 118580698 |
| 4367 | 194337072 |
| 4368 | 91790851 |
| 4369 | 330807438 |
| 4370 | 392420321 |
| 4371 | 226306380 |
| 4372 | 192289539 |
| 4373 | 90022397 |
| 4374 | 378453456 |
| 4375 | 383499050 |
| 4376 | 16767735 |
| 4377 | 378702324 |
| 4378 | 379703728 |
| 4379 | 378987158 |
| 4380 | 378447798 |
| 4381 | 378991752 |
| 4382 | 257063036 |
| 4383 | 284039696 |
| 4384 | 313682820 |
| 4385 | 427712036 |
| 4386 | 114566530 |
| 4387 | 114567994 |
| 4388 | 85858743 |
| 4389 | 438001509 |
| 4390 | 332798533 |
| 4391 | 217968755 |
| 4392 | 410668518 |
| 4393 | 304316009 |
| 4394 | 431933014 |
| 4395 | 229608794 |
| 4396 | 360034506 |
| 4397 | 260753608 |
| 4398 | 83311146 |
| 4399 | 120553502 |
| 4400 | 186685713 |
| 4401 | 146279743 |
| 4402 | 338213682 |
| 4403 | 432329232 |
| 4404 | 392407893 |
| 4405 | 169830971 |
| 4406 | 206895834 |
| 4407 | 428774398 |
| 4408 | 291286512 |
| 4409 | 431792784 |
| 4410 | 253699436 |
| 4411 | 327312664 |
| 4412 | 148270871 |
| 4413 | 270307451 |
| 4414 | 89892746 |
| 4415 | 390948458 |
| 4416 | 296120274 |
| 4417 | 220915123 |
| 4418 | 262193326 |
| 4419 | 262193326 |
| 4420 | 257091663 |
| 4421 | 340792956 |
| 4422 | 86738724 |
| 4423 | 312193897 |
| 4424 | 336115651 |
| 4425 | 302864508 |
| 4426 | 145220606 |
| 4427 | 379706264 |
| 4428 | 121582711 |
| 4429 | 257054089 |
| 4430 | 134096620 |
| 4431 | 433601838 |
| 4432 | 430741030 |
| 4433 | 162448269 |
| 4434 | 32141095 |
| 4435 | 182433793 |
| 4436 | 72160406 |
| 4437 | 83642913 |
| 4438 | 270307677 |
| 4439 | 89893417 |
| 4440 | 390949841 |
| 4441 | 296123317 |
| 4442 | 220916266 |
| 4443 | 262193924 |
| 4444 | 262194483 |
| 4445 | 257094924 |
| 4446 | 340794639 |
| 4447 | 86741643 |
| 4448 | 312199462 |
| 4449 | 336118507 |
| 4450 | 302865798 |
| 4451 | 145223787 |
| 4452 | 379707998 |
| 4453 | 121582860 |
| 4454 | 257054593 |
| 4455 | 134101637 |
| 4456 | 433603651 |
| 4457 | 430742879 |
| 4458 | 162455968 |
| 4459 | 21224936 |
| 4460 | 182435403 |
| 4461 | 72161115 |
| 4462 | 83646201 |
| 4463 | 340752689 |
| 4464 | 470888963 |
| 4465 | 443475063 |
| 4466 | 384564493 |
| 4467 | 453074724 |
| 4468 | 375098943 |
| 4469 | 359765508 |
| 4470 | 451335432 |
| 4471 | 126666535 |
| 4472 | 291003195 |
| 4473 | 440700764 |
| 4474 | 168697897 |
| 4475 | 458780596 |
| 4476 | 383824742 |
| 4477 | 238063223 |
| 4478 | 383828984 |
| 4479 | 365878958 |
| 4480 | 149176308 |
| 4481 | 458859664 |
| 4482 | 441515892 |
| 4483 | 254821514 |
| 4484 | 381168768 |
| 4485 | 88810591 |
| 4486 | 288920052 |
| 4487 | 452746645 |
| 4488 | 319947889 |
| 4489 | 643706995 |
| 4490 | 2506688718 |
| 4491 | 378443454 |
| 4492 | 644886772 |
| 4493 | 649671137 |
| 4494 | 326402148 |
| 4495 | 344198243 |
| 4496 | 169786889 |
| 4497 | 407698262 |
| 4498 | 86156430 |
| 4499 | 56475432 |
| 4500 | 146351220 |
| 4501 | 374998023 |
| 4502 | 386866198 |
| 4503 | 410470815 |
| 4504 | 323524377 |
| 4505 | 330814956 |
| 4506 | 134294128 |
| 4507 | 313671969 |
| 4508 | 78042616 |
| 4509 | 189499000 |
| 4510 | 374294493 |
| 4511 | 374294493 |
| 4512 | 300853232 |
| 4513 | 302384444 |
| 4514 | 302384444 |
| 4515 | 339441064 |

TABLE 17-continued

SEQ ID NO. vs. Accession Number Index

| SEQ ID NO. | Accession No. |
|---|---|
| 4516 | 339324158 |
| 4517 | 270307451 |
| 4518 | 300087139 |
| 4519 | 89892746 |
| 4520 | 408417460 |
| 4521 | 256827818 |
| 4522 | 402570638 |
| 4523 | 239904639 |
| 4524 | 387151873 |
| 4525 | 297567992 |
| 4526 | 401761514 |
| 4527 | 385785459 |
| 4528 | 387869382 |
| 4529 | 259906682 |
| 4530 | 85372828 |
| 4531 | 386632422 |
| 4532 | 386627502 |
| 4533 | 157159467 |
| 4534 | 260866153 |
| 4535 | 218561636 |
| 4536 | 172056045 |
| 4537 | 347534971 |
| 4538 | 302877245 |
| 4539 | 302877245 |
| 4540 | 239825584 |
| 4541 | 400756305 |
| 4542 | 332661890 |
| 4543 | 386712343 |
| 4544 | 435852812 |
| 4545 | 397655102 |
| 4546 | 385816611 |
| 4547 | 301065125 |
| 4548 | 385812838 |
| 4549 | 403514032 |
| 4550 | 268318562 |
| 4551 | 338202359 |
| 4552 | 385826720 |
| 4553 | 258506995 |
| 4554 | 296110131 |
| 4555 | 148642060 |
| 4556 | 397779166 |
| 4557 | 88601322 |
| 4558 | 336115651 |
| 4559 | 83588874 |
| 4560 | 304319677 |
| 4561 | 403056439 |
| 4562 | 118578449 |
| 4563 | 194335182 |
| 4564 | 91790731 |
| 4565 | 330806657 |
| 4566 | 392419087 |
| 4567 | 93004831 |
| 4568 | 226303489 |
| 4569 | 192288433 |
| 4570 | 90019649 |
| 4571 | 378448274 |
| 4572 | 383494824 |
| 4573 | 16763390 |
| 4574 | 378697983 |
| 4575 | 379699217 |
| 4576 | 378982542 |
| 4577 | 378987404 |
| 4578 | 330837866 |
| 4579 | 117918459 |
| 4580 | 113968346 |
| 4581 | 257062754 |
| 4582 | 284034943 |
| 4583 | 313681130 |
| 4584 | 427711179 |
| 4585 | 114565576 |
| 4586 | 114565576 |
| 4587 | 85857845 |
| 4588 | 438000910 |
| 4589 | 332798023 |
| 4590 | 237653092 |
| 4591 | 409131816 |
| 4592 | 304315537 |
| 4593 | 390948458 |
| 4594 | 431932943 |
| 4595 | 229606122 |
| 4596 | 360034408 |
| 4597 | 260752245 |
| 4598 | 83309099 |
| 4599 | 120552944 |
| 4600 | 186680550 |
| 4601 | 146279170 |
| 4602 | 338209545 |
| 4603 | 169237353 |
| 4604 | 344209485 |
| 4605 | 345006827 |
| 4606 | 433593057 |
| 4607 | 296120274 |
| 4608 | 220915123 |
| 4609 | 262193326 |
| 4610 | 262193326 |
| 4611 | 302390797 |
| 4612 | 117927211 |
| 4613 | 392406391 |
| 4614 | 150002608 |
| 4615 | 312792283 |
| 4616 | 219846956 |
| 4617 | 317151727 |
| 4618 | 146328629 |
| 4619 | 289191496 |
| 4620 | 336475959 |
| 4621 | 189218017 |
| 4622 | 83588874 |
| 4623 | 77163561 |
| 4624 | 300112745 |
| 4625 | 154250456 |
| 4626 | 154250456 |
| 4627 | 325106586 |
| 4628 | 297616214 |
| 4629 | 438000910 |
| 4630 | 332798023 |
| 4631 | 269791619 |
| 4632 | 320114857 |
| 4633 | 289577265 |
| 4634 | 167036431 |
| 4635 | 390933132 |
| 4636 | 433653743 |
| 4637 | 333895862 |
| 4638 | 396584758 |
| 4639 | 452732384 |
| 4640 | 472443541 |
| 4641 | 336440820 |
| 4642 | 476380507 |
| 4643 | 374627927 |
| 4644 | 472222746 |
| 4645 | 419173668 |
| 4646 | 331640257 |
| 4647 | 375004550 |
| 4648 | 421082290 |
| 4649 | 417605122 |
| 4650 | 332655353 |
| 4651 | 373485774 |
| 4652 | 417268567 |
| 4653 | 363900611 |
| 4654 | 419280801 |
| 4655 | 262371200 |
| 4656 | 256402721 |
| 4657 | 262374339 |
| 4658 | 418024796 |
| 4659 | 472199351 |
| 4660 | 419235449 |
| 4661 | 352101099 |
| 4662 | 226597601 |
| 4663 | 455877139 |
| 4664 | 407801688 |
| 4665 | 424026168 |

TABLE 17-continued

SEQ ID NO. vs. Accession Number Index

| SEQ ID NO. | Accession No. |
|---|---|
| 4666 | 443537933 |
| 4667 | 329896015 |
| 4668 | 313151045 |
| 4669 | 470894026 |
| 4670 | 420093456 |
| 4671 | 443474995 |
| 4672 | 423730148 |
| 4673 | 452301294 |
| 4674 | 452281584 |
| 4675 | 320096521 |
| 4676 | 373114969 |
| 4677 | 421857666 |
| 4678 | 422905795 |
| 4679 | 421735395 |
| 4680 | 293373625 |
| 4681 | 424001199 |
| 4682 | 410105720 |
| 4683 | 301030692 |
| 4684 | 319430354 |
| 4685 | 472217717 |
| 4686 | 423286106 |
| 4687 | 425019536 |
| 4688 | 238756169 |
| 4689 | 398800292 |
| 4690 | 433099189 |
| 4691 | 452722814 |
| 4692 | 419389168 |
| 4693 | 242362072 |
| 4694 | 422028620 |
| 4695 | 442594974 |
| 4696 | 407974869 |
| 4697 | 476381541 |
| 4698 | 452704090 |
| 4699 | 452743095 |
| 4700 | 425034026 |
| 4701 | 254426770 |
| 4702 | 424005355 |
| 4703 | 418354477 |
| 4704 | 450256199 |
| 4705 | 223955923 |
| 4706 | 452722284 |
| 4707 | 449053971 |
| 4708 | 386289604 |
| 4709 | 359780050 |
| 4710 | 411116154 |
| 4711 | 224581172 |
| 4712 | 452301765 |
| 4713 | 422033758 |
| 4714 | 422912392 |
| 4715 | 296328579 |
| 4716 | 294784664 |
| 4717 | 262377679 |
| 4718 | 418013522 |
| 4719 | 476381295 |
| 4720 | 293611286 |
| 4721 | 423144195 |
| 4722 | 224581037 |
| 4723 | 469923807 |
| 4724 | 336420422 |
| 4725 | 237666990 |
| 4726 | 417550237 |
| 4727 | 390606126 |
| 4728 | 254692771 |
| 4729 | 211594571 |
| 4730 | 415823418 |
| 4731 | 301064104 |
| 4732 | 238694717 |
| 4733 | 386814329 |
| 4734 | 476381563 |
| 4735 | 295396063 |
| 4736 | 419200062 |
| 4737 | 423718272 |
| 4738 | 423926641 |
| 4739 | 424977968 |
| 4740 | 424971161 |
| 4741 | 229509077 |
| 4742 | 340358330 |
| 4743 | 424023365 |
| 4744 | 424612424 |
| 4745 | 443530314 |
| 4746 | 424605785 |
| 4747 | 357040530 |
| 4748 | 455967306 |
| 4749 | 149189552 |
| 4750 | 385881638 |
| 4751 | 427597607 |
| 4752 | 389575461 |
| 4753 | 442610050 |
| 4754 | 182624174 |
| 4755 | 211595724 |
| 4756 | 419887425 |
| 4757 | 472214599 |
| 4758 | 422901577 |
| 4759 | 406351917 |
| 4760 | 225001047 |
| 4761 | 419281346 |
| 4762 | 356907979 |
| 4763 | 419206516 |
| 4764 | 406839856 |
| 4765 | 440708760 |
| 4766 | 424651801 |
| 4767 | 472210693 |
| 4768 | 196250231 |
| 4769 | 476380904 |
| 4770 | 427557910 |
| 4771 | 224515124 |
| 4772 | 381395491 |
| 4773 | 422702452 |
| 4774 | 409167416 |
| 4775 | 476380862 |
| 4776 | 358069018 |
| 4777 | 421345543 |
| 4778 | 417812631 |
| 4779 | 401676751 |
| 4780 | 314998443 |
| 4781 | 421334477 |
| 4782 | 423532168 |
| 4783 | 149113251 |
| 4784 | 422924875 |
| 4785 | 423891867 |
| 4786 | 419378419 |
| 4787 | 427682108 |
| 4788 | 423480222 |
| 4789 | 421772441 |
| 4790 | 448689403 |
| 4791 | 421768382 |
| 4792 | 427621994 |
| 4793 | 343503287 |
| 4794 | 472166833 |
| 4795 | 418348058 |
| 4796 | 427575979 |
| 4797 | 419252283 |
| 4798 | 455819031 |
| 4799 | 424609621 |
| 4800 | 476380950 |
| 4801 | 469924283 |
| 4802 | 472149938 |
| 4803 | 417209278 |
| 4804 | 390169096 |
| 4805 | 455593728 |
| 4806 | 424644158 |
| 4807 | 452702507 |
| 4808 | 472157757 |
| 4809 | 224581092 |
| 4810 | 427658715 |
| 4811 | 417589425 |
| 4812 | 294807000 |
| 4813 | 419362951 |
| 4814 | 345651578 |
| 4815 | 373849145 |

TABLE 17-continued

SEQ ID NO. vs. Accession Number Index

| SEQ ID NO. | Accession No. |
|---|---|
| 4816 | 410618100 |
| 4817 | 224485776 |
| 4818 | 298384183 |
| 4819 | 419358064 |
| 4820 | 419352509 |
| 4821 | 417223690 |
| 4822 | 381157709 |
| 4823 | 472183758 |
| 4824 | 424655749 |
| 4825 | 334126448 |
| 4826 | 126665966 |
| 4827 | 423709466 |
| 4828 | 437842748 |
| 4829 | 418008622 |
| 4830 | 469924241 |
| 4831 | 410637153 |
| 4832 | 363898451 |
| 4833 | 472152144 |
| 4834 | 419240736 |
| 4835 | 419383938 |
| 4836 | 424630728 |
| 4837 | 374627936 |
| 4838 | 418342894 |
| 4839 | 420088308 |
| 4840 | 255743719 |
| 4841 | 455929923 |
| 4842 | 206975561 |
| 4843 | 417522340 |
| 4844 | 419831962 |
| 4845 | 139439021 |
| 4846 | 314944229 |
| 4847 | 423147095 |
| 4848 | 224485442 |
| 4849 | 422305960 |
| 4850 | 225363921 |
| 4851 | 417815500 |
| 4852 | 425040990 |
| 4853 | 343177620 |
| 4854 | 423878932 |
| 4855 | 211593993 |
| 4856 | 418398711 |
| 4857 | 378759082 |
| 4858 | 402296507 |
| 4859 | 259048327 |
| 4860 | 455905617 |
| 4861 | 224514842 |
| 4862 | 357631901 |
| 4863 | 384096966 |
| 4864 | 425069205 |
| 4865 | 265756999 |
| 4866 | 427646214 |
| 4867 | 403955718 |
| 4868 | 373471569 |
| 4869 | 456039135 |
| 4870 | 224993695 |
| 4871 | 149109670 |
| 4872 | 365096837 |
| 4873 | 395208219 |
| 4874 | 458920171 |
| 4875 | 419246266 |
| 4876 | 423155496 |
| 4877 | 421624890 |
| 4878 | 427425534 |
| 4879 | 458913812 |
| 4880 | 417191381 |
| 4881 | 424621178 |
| 4882 | 262405036 |
| 4883 | 419229938 |
| 4884 | 424015456 |
| 4885 | 335043876 |
| 4886 | 419894708 |
| 4887 | 472202862 |
| 4888 | 211594035 |
| 4889 | 424618529 |
| 4890 | 224581212 |
| 4891 | 169343945 |
| 4892 | 405982616 |
| 4893 | 469924367 |
| 4894 | 417292897 |
| 4895 | 418336054 |
| 4896 | 423152690 |
| 4897 | 419841668 |
| 4898 | 421338374 |
| 4899 | 365822320 |
| 4900 | 294645413 |
| 4901 | 419367985 |
| 4902 | 419343475 |
| 4903 | 365833706 |
| 4904 | 448302553 |
| 4905 | 448681954 |
| 4906 | 470888868 |
| 4907 | 443475057 |
| 4908 | 386810750 |
| 4909 | 196035064 |
| 4910 | 419725778 |
| 4911 | 419725778 |
| 4912 | 336430981 |
| 4913 | 242355593 |
| 4914 | 397905651 |
| 4915 | 390993910 |
| 4916 | 390993910 |
| 4917 | 323701113 |
| 4918 | 288572734 |
| 4919 | 325672510 |
| 4920 | 408373871 |
| 4921 | 423394306 |
| 4922 | 254434980 |
| 4923 | 334130722 |
| 4924 | 472439485 |
| 4925 | 398888999 |
| 4926 | 196044104 |
| 4927 | 415887008 |
| 4928 | 343509531 |
| 4929 | 343509531 |
| 4930 | 343509531 |
| 4931 | 381156824 |
| 4932 | 326204471 |
| 4933 | 326389902 |
| 4934 | 256752440 |
| 4935 | 211606481 |
| 4936 | 2531818232 |
| 4937 | 2530355707 |
| 4938 | 2539290621 |
| 4939 | MMU_RS00570 |
| 4940 | 2532387807 |
| 4941 | 650170654 |
| 4942 | 2519332543 |
| 4943 | 650306797 |
| 4944 | 2532279095 |
| 4945 | 650174912 |
| 4946 | 650147799 |
| 4947 | 373108119 |
| 4948 | 2502297846 |
| 4949 | 373108120 |
| 4950 | 2531826025 |
| 4951 | 399579771 |
| 4952 | 374534854 |
| 4953 | 326402595 |
| 4954 | 344200465 |
| 4955 | 169786944 |
| 4956 | 407700182 |
| 4957 | 86159656 |
| 4958 | 56478397 |
| 4959 | 403571626 |
| 4960 | 374998149 |
| 4961 | 386867047 |
| 4962 | 410471294 |
| 4963 | 323527071 |
| 4964 | 330816346 |
| 4965 | 134296121 |

TABLE 17-continued

SEQ ID NO. vs. Accession Number Index

| SEQ ID NO. | Accession No. |
|---|---|
| 4966 | 313673975 |
| 4967 | 78044585 |
| 4968 | 189500612 |
| 4969 | 374294724 |
| 4970 | 374297215 |
| 4971 | 300856437 |
| 4972 | 302387139 |
| 4973 | 302388017 |
| 4974 | 310658338 |
| 4975 | 339442901 |
| 4976 | 339327422 |
| 4977 | 270307694 |
| 4978 | 300088705 |
| 4979 | 89893421 |
| 4980 | 408420315 |
| 4981 | 256829115 |
| 4982 | 402570959 |
| 4983 | 239908253 |
| 4984 | 387153153 |
| 4985 | 297570111 |
| 4986 | 401762044 |
| 4987 | 385787391 |
| 4988 | 387872410 |
| 4989 | 259909430 |
| 4990 | 85375770 |
| 4991 | 386637210 |
| 4992 | 386632290 |
| 4993 | 157159789 |
| 4994 | 260871026 |
| 4995 | 218561657 |
| 4996 | 172056355 |
| 4997 | 347535923 |
| 4998 | 302878114 |
| 4999 | 302878739 |
| 5000 | 239826787 |
| 5001 | 400756604 |
| 5002 | 332661910 |
| 5003 | 386716369 |
| 5004 | 435853824 |
| 5005 | 397655648 |
| 5006 | 385817604 |
| 5007 | 301067096 |
| 5008 | 385813809 |
| 5009 | 403515037 |
| 5010 | 268319510 |
| 5011 | 338203658 |
| 5012 | 385828739 |
| 5013 | 258509095 |
| 5014 | 296110181 |
| 5015 | 148643809 |
| 5016 | 397780113 |
| 5017 | 88602375 |
| 5018 | 336119446 |
| 5019 | 83591065 |
| 5020 | 304320704 |
| 5021 | 403059706 |
| 5022 | 118580706 |
| 5023 | 194337066 |
| 5024 | 253987910 |
| 5025 | 91790841 |
| 5026 | 330807432 |
| 5027 | 392420331 |
| 5028 | 93006435 |
| 5029 | 226306385 |
| 5030 | 192289534 |
| 5031 | 90022404 |
| 5032 | 378453463 |
| 5033 | 383499057 |
| 5034 | 16767742 |
| 5035 | 378702331 |
| 5036 | 379703735 |
| 5037 | 378987165 |
| 5038 | 378447805 |
| 5039 | 378991759 |
| 5040 | 330838573 |
| 5041 | 117920263 |
| 5042 | 113970045 |
| 5043 | 257063043 |
| 5044 | 284039689 |
| 5045 | 313682809 |
| 5046 | 427712028 |
| 5047 | 114566519 |
| 5048 | 114568002 |
| 5049 | 85858754 |
| 5050 | 438001500 |
| 5051 | 332798527 |
| 5052 | 217968744 |
| 5053 | 410668523 |
| 5054 | 304316004 |
| 5055 | 390949850 |
| 5056 | 431933024 |
| 5057 | 229608800 |
| 5058 | 360034501 |
| 5059 | 260753603 |
| 5060 | 83311137 |
| 5061 | 120553492 |
| 5062 | 186685714 |
| 5063 | 146279749 |
| 5064 | 338213691 |
| 5065 | 336252375 |
| 5066 | 169237558 |
| 5067 | 222476096 |
| 5068 | 344209887 |
| 5069 | 345007035 |
| 5070 | 433593286 |
| 5071 | 296123322 |
| 5072 | 220916260 |
| 5073 | 262193919 |
| 5074 | 262194478 |
| 5075 | 302392141 |
| 5076 | 117928026 |
| 5077 | 392408174 |
| 5078 | 150006235 |
| 5079 | 312792860 |
| 5080 | 219848038 |
| 5081 | 317153370 |
| 5082 | 146328877 |
| 5083 | 289192378 |
| 5084 | 336477228 |
| 5085 | 189218336 |
| 5086 | 83589504 |
| 5087 | 77163612 |
| 5088 | 300112790 |
| 5089 | 154251628 |
| 5090 | 154253992 |
| 5091 | 325107707 |
| 5092 | 297617449 |
| 5093 | 438003070 |
| 5094 | 332799806 |
| 5095 | 269793093 |
| 5096 | 320115759 |
| 5097 | 289578541 |
| 5098 | 167037343 |
| 5099 | 390935373 |
| 5100 | 433655482 |
| 5101 | 333896810 |
| 5102 | 396584771 |
| 5103 | 458152045 |
| 5104 | 472443545 |
| 5105 | 336440367 |
| 5106 | 432379522 |
| 5107 | 374625977 |
| 5108 | 472222753 |
| 5109 | 419173689 |
| 5110 | 331001729 |
| 5111 | 375004441 |
| 5112 | 421082308 |
| 5113 | 417605265 |
| 5114 | 332655416 |
| 5115 | 373485785 |

TABLE 17-continued

SEQ ID NO. vs. Accession Number Index

| SEQ ID NO. | Accession No. |
|---|---|
| 5116 | 417270173 |
| 5117 | 363899397 |
| 5118 | 419281130 |
| 5119 | 262371249 |
| 5120 | 260887941 |
| 5121 | 262374463 |
| 5122 | 418024977 |
| 5123 | 472199358 |
| 5124 | 419235451 |
| 5125 | 352101114 |
| 5126 | 229817499 |
| 5127 | 443510722 |
| 5128 | 407801754 |
| 5129 | 424026175 |
| 5130 | 443537943 |
| 5131 | 329896084 |
| 5132 | 307287298 |
| 5133 | 470894104 |
| 5134 | 420093467 |
| 5135 | 443475022 |
| 5136 | 423730156 |
| 5137 | 458790585 |
| 5138 | 458059912 |
| 5139 | 320095079 |
| 5140 | 373113611 |
| 5141 | 421857671 |
| 5142 | 422905802 |
| 5143 | 421735410 |
| 5144 | 293373691 |
| 5145 | 424001206 |
| 5146 | 410103031 |
| 5147 | 301024309 |
| 5148 | 317501016 |
| 5149 | 472217724 |
| 5150 | 423288076 |
| 5151 | 425019537 |
| 5152 | 238756189 |
| 5153 | 398800469 |
| 5154 | 433099196 |
| 5155 | 457927364 |
| 5156 | 419389188 |
| 5157 | 229814947 |
| 5158 | 422028739 |
| 5159 | 442594978 |
| 5160 | 407974990 |
| 5161 | 432983125 |
| 5162 | 457996552 |
| 5163 | 458890352 |
| 5164 | 425034027 |
| 5165 | 254429639 |
| 5166 | 424005362 |
| 5167 | 418354574 |
| 5168 | 450256211 |
| 5169 | 313140117 |
| 5170 | 458765354 |
| 5171 | 449054089 |
| 5172 | 386288256 |
| 5173 | 359780192 |
| 5174 | 366164462 |
| 5175 | 317058273 |
| 5176 | 458013689 |
| 5177 | 422033790 |
| 5178 | 422912398 |
| 5179 | 296328615 |
| 5180 | 294785575 |
| 5181 | 262377711 |
| 5182 | 418013531 |
| 5183 | 432708021 |
| 5184 | 293611304 |
| 5185 | 423144201 |
| 5186 | 223986440 |
| 5187 | 430834457 |
| 5188 | 336418217 |
| 5189 | 237668144 |
| 5190 | 417550475 |
| 5191 | 388258095 |
| 5192 | 257438028 |
| 5193 | 114706333 |
| 5194 | 415823690 |
| 5195 | 301064129 |
| 5196 | 227889974 |
| 5197 | 386818309 |
| 5198 | 432993615 |
| 5199 | 295396113 |
| 5200 | 419200151 |
| 5201 | 423719991 |
| 5202 | 423926648 |
| 5203 | 424977969 |
| 5204 | 424971162 |
| 5205 | 229509128 |
| 5206 | 340357063 |
| 5207 | 424023371 |
| 5208 | 424612431 |
| 5209 | 443530594 |
| 5210 | 424605792 |
| 5211 | 357040623 |
| 5212 | 443522965 |
| 5213 | 149189598 |
| 5214 | 386775206 |
| 5215 | 427597642 |
| 5216 | 389577853 |
| 5217 | 442610065 |
| 5218 | 182624257 |
| 5219 | 153821444 |
| 5220 | 419887469 |
| 5221 | 472214605 |
| 5222 | 422901578 |
| 5223 | 404368581 |
| 5224 | 86139888 |
| 5225 | 419281503 |
| 5226 | 357010164 |
| 5227 | 419206519 |
| 5228 | 407366557 |
| 5229 | 440708890 |
| 5230 | 424651808 |
| 5231 | 472210699 |
| 5232 | 196250359 |
| 5233 | 432551900 |
| 5234 | 427557943 |
| 5235 | 210635259 |
| 5236 | 381395614 |
| 5237 | 422702471 |
| 5238 | 409203052 |
| 5239 | 432531967 |
| 5240 | 358066716 |
| 5241 | 421345611 |
| 5242 | 417812640 |
| 5243 | 401676813 |
| 5244 | 314996683 |
| 5245 | 421334488 |
| 5246 | 423535446 |
| 5247 | 167991286 |
| 5248 | 422924882 |
| 5249 | 423891874 |
| 5250 | 419378584 |
| 5251 | 427682142 |
| 5252 | 423480947 |
| 5253 | 421772571 |
| 5254 | 448689859 |
| 5255 | 421768513 |
| 5256 | 427622026 |
| 5257 | 343503397 |
| 5258 | 472166840 |
| 5259 | 418348066 |
| 5260 | 427576011 |
| 5261 | 419252319 |
| 5262 | 443506617 |
| 5263 | 424609627 |
| 5264 | 432566734 |
| 5265 | 431640912 |

TABLE 17-continued

SEQ ID NO. vs. Accession Number Index

| SEQ ID NO. | Accession No. |
|---|---|
| 5266 | 472149945 |
| 5267 | 417209283 |
| 5268 | 390169179 |
| 5269 | 443502702 |
| 5270 | 424644165 |
| 5271 | 458688575 |
| 5272 | 472157764 |
| 5273 | 302520235 |
| 5274 | 427658747 |
| 5275 | 417589503 |
| 5276 | 294807073 |
| 5277 | 419363104 |
| 5278 | 345508162 |
| 5279 | 373849354 |
| 5280 | 410618148 |
| 5281 | 224023324 |
| 5282 | 298384296 |
| 5283 | 419358139 |
| 5284 | 419352610 |
| 5285 | 417223908 |
| 5286 | 381159244 |
| 5287 | 472183764 |
| 5288 | 424655756 |
| 5289 | 334125669 |
| 5290 | 126665997 |
| 5291 | 423709631 |
| 5292 | 437842753 |
| 5293 | 418008633 |
| 5294 | 431534711 |
| 5295 | 410637162 |
| 5296 | 363897445 |
| 5297 | 472152150 |
| 5298 | 419240873 |
| 5299 | 419383946 |
| 5300 | 424630791 |
| 5301 | 374630020 |
| 5302 | 418342900 |
| 5303 | 420088377 |
| 5304 | 255743726 |
| 5305 | 443518098 |
| 5306 | 206975566 |
| 5307 | 417522348 |
| 5308 | 419832015 |
| 5309 | 139439063 |
| 5310 | 314941479 |
| 5311 | 423147143 |
| 5312 | 255014563 |
| 5313 | 422306078 |
| 5314 | 254850926 |
| 5315 | 417815509 |
| 5316 | 425040991 |
| 5317 | 340752713 |
| 5318 | 423878984 |
| 5319 | 90418999 |
| 5320 | 418398872 |
| 5321 | 381199745 |
| 5322 | 402700379 |
| 5323 | 260101570 |
| 5324 | 443514284 |
| 5325 | 160944222 |
| 5326 | 358012810 |
| 5327 | 383114785 |
| 5328 | 425069874 |
| 5329 | 265757021 |
| 5330 | 427646246 |
| 5331 | 404399334 |
| 5332 | 373469122 |
| 5333 | 443534356 |
| 5334 | 225374528 |
| 5335 | 167551248 |
| 5336 | 365096841 |
| 5337 | 395208378 |
| 5338 | 458920178 |
| 5339 | 419246584 |
| 5340 | 423155502 |
| 5341 | 421624927 |
| 5342 | 427425605 |
| 5343 | 458913831 |
| 5344 | 417191592 |
| 5345 | 424621185 |
| 5346 | 262405135 |
| 5347 | 419230123 |
| 5348 | 424015508 |
| 5349 | 335043949 |
| 5350 | 419894759 |
| 5351 | 472202869 |
| 5352 | 89073849 |
| 5353 | 424618577 |
| 5354 | 237744585 |
| 5355 | 169343970 |
| 5356 | 405982588 |
| 5357 | 431753899 |
| 5358 | 417293178 |
| 5359 | 418336064 |
| 5360 | 423152696 |
| 5361 | 419841769 |
| 5362 | 421338424 |
| 5363 | 366087504 |
| 5364 | 294645431 |
| 5365 | 419368024 |
| 5366 | 419343549 |
| 5367 | 365831804 |
| 5368 | 448302571 |
| 5369 | 448682081 |
| 5370 | 470888968 |
| 5371 | 443475074 |
| 5372 | 386811036 |
| 5373 | 196035248 |
| 5374 | 419725839 |
| 5375 | 419725840 |
| 5376 | 336426887 |
| 5377 | 397905672 |
| 5378 | 392538880 |
| 5379 | 392538881 |
| 5380 | 323701239 |
| 5381 | 288575094 |
| 5382 | 325266727 |
| 5383 | 408373937 |
| 5384 | 423398556 |
| 5385 | 254435793 |
| 5386 | 334130732 |
| 5387 | 472439495 |
| 5388 | 398889055 |
| 5389 | 196044133 |
| 5390 | 415887050 |
| 5391 | 343509534 |
| 5392 | 343509535 |
| 5393 | 343509536 |
| 5394 | 381156858 |
| 5395 | 326204502 |
| 5396 | 326389938 |
| 5397 | 256752459 |
| 5398 | 88811241 |
| 5399 | 424979863 |
| 5400 | 2530355707 |
| 5401 | 433118462 |
| 5402 | 458067976 |
| 5403 | 419919262 |
| 5404 | 314950597 |
| 5405 | 425024182 |
| 5406 | 650306797 |
| 5407 | 425047892 |
| 5408 | 314992451 |
| 5409 | 314939181 |
| 5410 | 373106083 |
| 5411 | 227544819 |
| 5412 | 373106631 |
| 5413 | 404330921 |
| 5414 | 424974922 |
| 5415 | 374812249 |

TABLE 17-continued

SEQ ID NO. vs. Accession Number Index

| SEQ ID NO. | Accession No. |
|---|---|
| 5416 | 643706993 |
| 5417 | 2506688720 |
| 5418 | 378443454 |
| 5419 | 644886773 |
| 5420 | 649671138 |
| 5421 | 326402148 |
| 5422 | 344198243 |
| 5423 | 169786889 |
| 5424 | 407698262 |
| 5425 | 86156430 |
| 5426 | 56475432 |
| 5427 | 146351220 |
| 5428 | 374998023 |
| 5429 | 386866198 |
| 5430 | 410470815 |
| 5431 | 323524377 |
| 5432 | 330814956 |
| 5433 | 134294128 |
| 5434 | 313671969 |
| 5435 | 78042616 |
| 5436 | 189499000 |
| 5437 | 374294493 |
| 5438 | 374294493 |
| 5439 | 300853232 |
| 5440 | 302384444 |
| 5441 | 302384444 |
| 5442 | 339441064 |
| 5443 | 339324158 |
| 5444 | 257057919 |
| 5445 | 300087139 |
| 5446 | 408417460 |
| 5447 | 256827818 |
| 5448 | 402570638 |
| 5449 | 239904639 |
| 5450 | 46562128 |
| 5451 | 387151873 |
| 5452 | 297567992 |
| 5453 | 401761514 |
| 5454 | 385785459 |
| 5455 | 387869382 |
| 5456 | 259906682 |
| 5457 | 85372828 |
| 5458 | 386632422 |
| 5459 | 386627502 |
| 5460 | 157159467 |
| 5461 | 260866153 |
| 5462 | 218561636 |
| 5463 | 172056045 |
| 5464 | 347534971 |
| 5465 | 302877245 |
| 5466 | 302877245 |
| 5467 | 239825584 |
| 5468 | 400756305 |
| 5469 | 332661890 |
| 5470 | 386712343 |
| 5471 | 435852812 |
| 5472 | 397655102 |
| 5473 | 385816611 |
| 5474 | 301065125 |
| 5475 | 385812838 |
| 5476 | 403514032 |
| 5477 | 268318562 |
| 5478 | 338202359 |
| 5479 | 385826720 |
| 5480 | 258506995 |
| 5481 | 296110131 |
| 5482 | 148642060 |
| 5483 | 397779166 |
| 5484 | 409187964 |
| 5485 | 435850242 |
| 5486 | 20088899 |
| 5487 | 21226102 |
| 5488 | 88601322 |
| 5489 | 88601322 |
| 5490 | 336115651 |
| 5491 | 83588874 |
| 5492 | 304319677 |
| 5493 | 403056439 |
| 5494 | 118578449 |
| 5495 | 194335182 |
| 5496 | 91790731 |
| 5497 | 330806657 |
| 5498 | 392419087 |
| 5499 | 93004831 |
| 5500 | 226303489 |
| 5501 | 192288433 |
| 5502 | 90019649 |
| 5503 | 378448274 |
| 5504 | 383494824 |
| 5505 | 16763390 |
| 5506 | 378697983 |
| 5507 | 379699217 |
| 5508 | 378982542 |
| 5509 | 378987404 |
| 5510 | 330837866 |
| 5511 | 117918459 |
| 5512 | 113968346 |
| 5513 | 257062754 |
| 5514 | 284034943 |
| 5515 | 313681130 |
| 5516 | 427711179 |
| 5517 | 114565576 |
| 5518 | 114565576 |
| 5519 | 85857845 |
| 5520 | 438000910 |
| 5521 | 332798023 |
| 5522 | 237653092 |
| 5523 | 409131816 |
| 5524 | 304315537 |
| 5525 | 390948458 |
| 5526 | 431932943 |
| 5527 | 229606122 |
| 5528 | 360034408 |
| 5529 | 260752245 |
| 5530 | 83309099 |
| 5531 | 120552944 |
| 5532 | 186680550 |
| 5533 | 146279170 |
| 5534 | 338209545 |
| 5535 | 257051090 |
| 5536 | 169237353 |
| 5537 | 344209485 |
| 5538 | 345006827 |
| 5539 | 433593057 |
| 5540 | 296120274 |
| 5541 | 220915123 |
| 5542 | 262193326 |
| 5543 | 262193326 |
| 5544 | 343177620 |
| 5545 | 470888868 |
| 5546 | 443475057 |
| 5547 | 384563951 |
| 5548 | 453074660 |
| 5549 | 375098335 |
| 5550 | 359765453 |
| 5551 | 451335404 |
| 5552 | 126666487 |
| 5553 | 257461537 |
| 5554 | 440700728 |
| 5555 | 163804182 |
| 5556 | 458780588 |
| 5557 | 383824531 |
| 5558 | 224581088 |
| 5559 | 383827549 |
| 5560 | 365878943 |
| 5561 | 149176214 |
| 5562 | 458859600 |
| 5563 | 441515884 |
| 5564 | 163719735 |
| 5565 | 381168746 |

TABLE 17-continued

SEQ ID NO. vs. Accession Number Index

| SEQ ID NO. | Accession No. |
|---|---|
| 5566 | 211606481 |
| 5567 | 288920043 |
| 5568 | 452746574 |
| 5569 | 319947885 |
| 5570 | 326402594 |
| 5571 | 344200466 |
| 5572 | 169786943 |
| 5573 | 407700181 |
| 5574 | 86159655 |
| 5575 | 56478398 |
| 5576 | 403571625 |
| 5577 | 374998148 |
| 5578 | 386867048 |
| 5579 | 410471295 |
| 5580 | 323527070 |
| 5581 | 330816347 |
| 5582 | 134296120 |
| 5583 | 313673974 |
| 5584 | 78043641 |
| 5585 | 189500611 |
| 5586 | 374294725 |
| 5587 | 374297214 |
| 5588 | 300856436 |
| 5589 | 302387138 |
| 5590 | 302388016 |
| 5591 | 310658339 |
| 5592 | 339442902 |
| 5593 | 339327421 |
| 5594 | 257060039 |
| 5595 | 300088704 |
| 5596 | 408420314 |
| 5597 | 256829114 |
| 5598 | 402570960 |
| 5599 | 239908252 |
| 5600 | 46580433 |
| 5601 | 387153154 |
| 5602 | 297570110 |
| 5603 | 401762043 |
| 5604 | 385787390 |
| 5605 | 387872411 |
| 5606 | 259909431 |
| 5607 | 85375772 |
| 5608 | 386637211 |
| 5609 | 386632291 |
| 5610 | 157159790 |
| 5611 | 260871025 |
| 5612 | 218561658 |
| 5613 | 172056356 |
| 5614 | 347535922 |
| 5615 | 302878115 |
| 5616 | 302878740 |
| 5617 | 239826788 |
| 5618 | 39997207 |
| 5619 | 332661909 |
| 5620 | 386716368 |
| 5621 | 435853825 |
| 5622 | 397655647 |
| 5623 | 385817605 |
| 5624 | 301067095 |
| 5625 | 385813808 |
| 5626 | 403515036 |
| 5627 | 268319509 |
| 5628 | 338203659 |
| 5629 | 385828738 |
| 5630 | 258509094 |
| 5631 | 296110180 |
| 5632 | 148643810 |
| 5633 | 397780112 |
| 5634 | 410669356 |
| 5635 | 435851551 |
| 5636 | 20091206 |
| 5637 | 21226255 |
| 5638 | 88602374 |
| 5639 | 88603149 |
| 5640 | 336119447 |
| 5641 | 83591064 |
| 5642 | 304320703 |
| 5643 | 403059707 |
| 5644 | 118580705 |
| 5645 | 194337067 |
| 5646 | 253987911 |
| 5647 | 91790842 |
| 5648 | 330807433 |
| 5649 | 392420330 |
| 5650 | 93006434 |
| 5651 | 226306384 |
| 5652 | 192289535 |
| 5653 | 90022403 |
| 5654 | 378453462 |
| 5655 | 383499056 |
| 5656 | 16767741 |
| 5657 | 378702330 |
| 5658 | 379703734 |
| 5659 | 378987164 |
| 5660 | 378447804 |
| 5661 | 378991758 |
| 5662 | 330838574 |
| 5663 | 117920264 |
| 5664 | 113970046 |
| 5665 | 257063042 |
| 5666 | 284039690 |
| 5667 | 313682810 |
| 5668 | 427712029 |
| 5669 | 114566520 |
| 5670 | 114568001 |
| 5671 | 85858752 |
| 5672 | 438001501 |
| 5673 | 332798528 |
| 5674 | 217968745 |
| 5675 | 410668522 |
| 5676 | 304316005 |
| 5677 | 390949849 |
| 5678 | 431933023 |
| 5679 | 229608799 |
| 5680 | 360034502 |
| 5681 | 260753604 |
| 5682 | 83311138 |
| 5683 | 120553493 |
| 5684 | 186685707 |
| 5685 | 146279748 |
| 5686 | 338213690 |
| 5687 | 336252377 |
| 5688 | 257052979 |
| 5689 | 169237556 |
| 5690 | 222476094 |
| 5691 | 344209885 |
| 5692 | 345007037 |
| 5693 | 433593288 |
| 5694 | 296123321 |
| 5695 | 220916261 |
| 5696 | 262193920 |
| 5697 | 262194479 |
| 5698 | 294807072 |
| 5699 | 345508161 |
| 5700 | 224023323 |
| 5701 | 381159245 |
| 5702 | 470888967 |
| 5703 | 396584768 |
| 5704 | 458152046 |
| 5705 | 472443546 |
| 5706 | 336440366 |
| 5707 | 432379521 |
| 5708 | 374625978 |
| 5709 | 424979862 |
| 5710 | 419173698 |
| 5711 | 331001730 |
| 5712 | 375004440 |
| 5713 | 421082307 |
| 5714 | 417605264 |
| 5715 | 332655415 |

TABLE 17-continued

SEQ ID NO. vs. Accession Number Index

| SEQ ID NO. | Accession No. |
|---|---|
| 5716 | 373485786 |
| 5717 | 417270040 |
| 5718 | 363899396 |
| 5719 | 419281129 |
| 5720 | 262371248 |
| 5721 | 260887940 |
| 5722 | 262374464 |
| 5723 | 418024978 |
| 5724 | 419235547 |
| 5725 | 352101113 |
| 5726 | 229817500 |
| 5727 | 407801755 |
| 5728 | 329896083 |
| 5729 | 433118461 |
| 5730 | 307287299 |
| 5731 | 470894103 |
| 5732 | 420093468 |
| 5733 | 443475021 |
| 5734 | 458059911 |
| 5735 | 320095080 |
| 5736 | 373113608 |
| 5737 | 373113609 |
| 5738 | 421857672 |
| 5739 | 421735409 |
| 5740 | 293373690 |
| 5741 | 410103030 |
| 5742 | 301024308 |
| 5743 | 317501017 |
| 5744 | 423288075 |
| 5745 | 425019538 |
| 5746 | 238756190 |
| 5747 | 398800470 |
| 5748 | 433099195 |
| 5749 | 419389187 |
| 5750 | 229814946 |
| 5751 | 422028738 |
| 5752 | 442594979 |
| 5753 | 407974989 |
| 5754 | 432983126 |
| 5755 | 457996553 |
| 5756 | 458890353 |
| 5757 | 425034028 |
| 5758 | 254427953 |
| 5759 | 450256210 |
| 5760 | 313140118 |
| 5761 | 419919261 |
| 5762 | 458765353 |
| 5763 | 449054088 |
| 5764 | 386288257 |
| 5765 | 359780191 |
| 5766 | 366164461 |
| 5767 | 317058274 |
| 5768 | 314950596 |
| 5769 | 422033789 |
| 5770 | 296328614 |
| 5771 | 294785574 |
| 5772 | 262377712 |
| 5773 | 418013530 |
| 5774 | 432708022 |
| 5775 | 293611305 |
| 5776 | 223986439 |
| 5777 | 430834456 |
| 5778 | 336418218 |
| 5779 | 237668630 |
| 5780 | 417550474 |
| 5781 | 388258094 |
| 5782 | 257438027 |
| 5783 | 114706332 |
| 5784 | 415823689 |
| 5785 | 425024181 |
| 5786 | 227889975 |
| 5787 | 386818310 |
| 5788 | 432993616 |
| 5789 | 295396112 |
| 5790 | 419200150 |
| 5791 | 423719992 |
| 5792 | 424977970 |
| 5793 | 424971163 |
| 5794 | 229509127 |
| 5795 | 340357064 |
| 5796 | 357040624 |
| 5797 | 425047891 |
| 5798 | 149189597 |
| 5799 | 386775207 |
| 5800 | 427597641 |
| 5801 | 389577852 |
| 5802 | 442610064 |
| 5803 | 182624189 |
| 5804 | 314992450 |
| 5805 | 153821461 |
| 5806 | 419887468 |
| 5807 | 404368582 |
| 5808 | 86139887 |
| 5809 | 419281502 |
| 5810 | 357010163 |
| 5811 | 419206636 |
| 5812 | 419206666 |
| 5813 | 407366556 |
| 5814 | 440708891 |
| 5815 | 196250358 |
| 5816 | 432551901 |
| 5817 | 427557942 |
| 5818 | 210635260 |
| 5819 | 381395615 |
| 5820 | 422702472 |
| 5821 | 409203051 |
| 5822 | 432531966 |
| 5823 | 358066715 |
| 5824 | 401676814 |
| 5825 | 314996684 |
| 5826 | 423535445 |
| 5827 | 314939180 |
| 5828 | 167991285 |
| 5829 | 419378583 |
| 5830 | 427682141 |
| 5831 | 423480948 |
| 5832 | 421772572 |
| 5833 | 448689858 |
| 5834 | 421768512 |
| 5835 | 427622025 |
| 5836 | 343503398 |
| 5837 | 427576010 |
| 5838 | 419252318 |
| 5839 | 227544818 |
| 5840 | 432566735 |
| 5841 | 431640911 |
| 5842 | 417209341 |
| 5843 | 390169178 |
| 5844 | 458688574 |
| 5845 | 404330920 |
| 5846 | 302520234 |
| 5847 | 427658746 |
| 5848 | 424974921 |
| 5849 | 417589502 |
| 5850 | 419363100 |
| 5851 | 298384295 |
| 5852 | 419358138 |
| 5853 | 419352609 |
| 5854 | 417224699 |
| 5855 | 282900779 |
| 5856 | 425444979 |
| 5857 | 472183765 |
| 5858 | 424655757 |
| 5859 | 334125670 |
| 5860 | 126665996 |
| 5861 | 423709630 |
| 5862 | 437842752 |
| 5863 | 418008632 |
| 5864 | 431534712 |
| 5865 | 410637163 |

TABLE 17-continued

SEQ ID NO. vs. Accession Number Index

| SEQ ID NO. | Accession No. |
|---|---|
| 5866 | 363897444 |
| 5867 | 472152151 |
| 5868 | 419240872 |
| 5869 | 419383945 |
| 5870 | 374629430 |
| 5871 | 374630019 |
| 5872 | 418342901 |
| 5873 | 420088376 |
| 5874 | 443518099 |
| 5875 | 206975742 |
| 5876 | 423164023 |
| 5877 | 417522347 |
| 5878 | 139439064 |
| 5879 | 314941480 |
| 5880 | 423147142 |
| 5881 | 255014564 |
| 5882 | 422306079 |
| 5883 | 254850927 |
| 5884 | 417815510 |
| 5885 | 425040992 |
| 5886 | 340752714 |
| 5887 | 423878985 |
| 5888 | 90418998 |
| 5889 | 418398871 |
| 5890 | 381199746 |
| 5891 | 402700380 |
| 5892 | 260101569 |
| 5893 | 443514285 |
| 5894 | 160944223 |
| 5895 | 358012809 |
| 5896 | 383114786 |
| 5897 | 425069875 |
| 5898 | 265757020 |
| 5899 | 427646245 |
| 5900 | 404399333 |
| 5901 | 373469123 |
| 5902 | 443534357 |
| 5903 | 225374527 |
| 5904 | 167551249 |
| 5905 | 365096842 |
| 5906 | 298528557 |
| 5907 | 395208454 |
| 5908 | 458920177 |
| 5909 | 419246583 |
| 5910 | 423155503 |
| 5911 | 421624915 |
| 5912 | 427425618 |
| 5913 | 458913830 |
| 5914 | 417191528 |
| 5915 | 424621186 |
| 5916 | 262405136 |
| 5917 | 422890702 |
| 5918 | 419230122 |
| 5919 | 424015509 |
| 5920 | 335043948 |
| 5921 | 419894758 |
| 5922 | 472202870 |
| 5923 | 89073848 |
| 5924 | 424618576 |
| 5925 | 237744584 |
| 5926 | 169343964 |
| 5927 | 405982587 |
| 5928 | 431753900 |
| 5929 | 417293264 |
| 5930 | 418336065 |
| 5931 | 423152697 |
| 5932 | 419841708 |
| 5933 | 421338423 |
| 5934 | 325918008 |
| 5935 | 366087503 |
| 5936 | 294645432 |
| 5937 | 419368147 |
| 5938 | 419343548 |
| 5939 | 365831805 |
| 5940 | 448302569 |
| 5941 | 448682079 |
| 5942 | 448413237 |
| 5943 | 443475073 |
| 5944 | 2530355708 |
| 5945 | 650306798 |
| 5946 | 373106084 |
| 5947 | 373106630 |
| 5948 | 302390797 |
| 5949 | 117927211 |
| 5950 | 392406391 |
| 5951 | 312792283 |
| 5952 | 219846956 |
| 5953 | 317151727 |
| 5954 | 146328629 |
| 5955 | 289191496 |
| 5956 | 336475959 |
| 5957 | 189218017 |
| 5958 | 83588874 |
| 5959 | 77163561 |
| 5960 | 300112745 |
| 5961 | 154250456 |
| 5962 | 154250456 |
| 5963 | 325106586 |
| 5964 | 297616214 |
| 5965 | 438000910 |
| 5966 | 332798023 |
| 5967 | 269791619 |
| 5968 | 320114857 |
| 5969 | 289577265 |
| 5970 | 167036431 |
| 5971 | 390933132 |
| 5972 | 433653743 |
| 5973 | 333895862 |
| 5974 | 386810750 |
| 5975 | 196035064 |
| 5976 | 336430981 |
| 5977 | 242355593 |
| 5978 | 397905651 |
| 5979 | 302392145 |
| 5980 | 117928019 |
| 5981 | 392408180 |
| 5982 | 312792856 |
| 5983 | 219848031 |
| 5984 | 317153363 |
| 5985 | 146328698 |
| 5986 | 289192374 |
| 5987 | 336477236 |
| 5988 | 189218342 |
| 5989 | 83589499 |
| 5990 | 77163602 |
| 5991 | 300112781 |
| 5992 | 154251635 |
| 5993 | 154253985 |
| 5994 | 325107713 |
| 5995 | 297617453 |
| 5996 | 438003074 |
| 5997 | 332799810 |
| 5998 | 269793100 |
| 5999 | 320115754 |
| 6000 | 289578546 |
| 6001 | 167037338 |
| 6002 | 390935378 |
| 6003 | 433655487 |
| 6004 | 333896805 |
| 6005 | 386811047 |
| 6006 | 196035241 |
| 6007 | 336426893 |
| 6008 | 257885933 |
| 6009 | 397905665 |
| 6010 | 392538886 |
| 6011 | 323701233 |
| 6012 | 288575103 |
| 6013 | 325266722 |
| 6014 | 408373946 |
| 6015 | 423398560 |

TABLE 17-continued

SEQ ID NO. vs. Accession Number Index

| SEQ ID NO. | Accession No. |
|---|---|
| 6016 | 254435536 |
| 6017 | 472439489 |
| 6018 | 398889060 |
| 6019 | 196044400 |
| 6020 | 374812240 |
| 6021 | 415887046 |
| 6022 | 343509541 |
| 6023 | 381156867 |
| 6024 | 374623711 |
| 6025 | 326204497 |
| 6026 | 326389944 |
| 6027 | 256752453 |
| 6028 | 88811251 |
| 6029 | 296120274 |
| 6030 | 220915123 |
| 6031 | 262193326 |
| 6032 | 262193326 |
| 6033 | 470888868 |
| 6034 | 443475057 |
| 6035 | 470888969 |
| 6036 | 443475075 |
| 6037 | 296123323 |
| 6038 | 220916259 |
| 6039 | 262193918 |
| 6040 | 262194477 |
| 6041 | 325106586 |
| 6042 | 83718394 |
| 6043 | 257091663 |
| 6044 | 383452024 |
| 6045 | 340792956 |
| 6046 | 86738724 |
| 6047 | 312193897 |
| 6048 | 262193326 |
| 6049 | 336115651 |
| 6050 | 302864508 |
| 6051 | 145220606 |
| 6052 | 379706264 |
| 6053 | 121582711 |
| 6054 | 257054089 |
| 6055 | 134096620 |
| 6056 | 433601838 |
| 6057 | 430741030 |
| 6058 | 162448269 |
| 6059 | 162448269 |
| 6060 | 162448269 |
| 6061 | 32141095 |
| 6062 | 182433793 |
| 6063 | 72160406 |
| 6064 | 296267998 |
| 6065 | 83642913 |
| 6066 | 384563951 |
| 6067 | 453074660 |
| 6068 | 375098335 |
| 6069 | 359765453 |
| 6070 | 451335404 |
| 6071 | 126666487 |
| 6072 | 257461537 |
| 6073 | 440700728 |
| 6074 | 163804182 |
| 6075 | 458780588 |
| 6076 | 383824531 |
| 6077 | 224581088 |
| 6078 | 383827549 |
| 6079 | 365878943 |
| 6080 | 254173939 |
| 6081 | 149176214 |
| 6082 | 458859600 |
| 6083 | 441515884 |
| 6084 | 163719735 |
| 6085 | 381168746 |
| 6086 | 211606481 |
| 6087 | 211606481 |
| 6088 | 288920043 |
| 6089 | 452746574 |
| 6090 | 325107743 |
| 6091 | 83720701 |
| 6092 | 257094932 |
| 6093 | 383457207 |
| 6094 | 340794635 |
| 6095 | 86741639 |
| 6096 | 312199458 |
| 6097 | 262194452 |
| 6098 | 336118511 |
| 6099 | 302865792 |
| 6100 | 145223791 |
| 6101 | 379708002 |
| 6102 | 121582867 |
| 6103 | 257054581 |
| 6104 | 134101641 |
| 6105 | 433603667 |
| 6106 | 430742885 |
| 6107 | 162455957 |
| 6108 | 162455970 |
| 6109 | 162455983 |
| 6110 | 21224924 |
| 6111 | 182435393 |
| 6112 | 72161105 |
| 6113 | 296269520 |
| 6114 | 83646207 |
| 6115 | 384564483 |
| 6116 | 453074717 |
| 6117 | 375098936 |
| 6118 | 359765504 |
| 6119 | 451335443 |
| 6120 | 126666550 |
| 6121 | 291003191 |
| 6122 | 440700787 |
| 6123 | 168697904 |
| 6124 | 458780602 |
| 6125 | 383824736 |
| 6126 | 238063210 |
| 6127 | 383828993 |
| 6128 | 365878962 |
| 6129 | 257140682 |
| 6130 | 149176313 |
| 6131 | 458859650 |
| 6132 | 441515888 |
| 6133 | 254821509 |
| 6134 | 381168760 |
| 6135 | 88810583 |
| 6136 | 88810585 |
| 6137 | 288920048 |
| 6138 | 452746641 |
| 6165 | 148643814 |
| 6166 | 640593578 |
| 6167 | 445667054 |
| 6168 | 2533732216 |
| 6169 | 257821793 |
| 6170 | 647719053 |
| 6171 | 644972976 |
| 6172 | 644972976 |
| 6173 | 650642708 |
| 6174 | 650642708 |
| 6175 | 2501566912 |
| 6176 | 2501566912 |
| 6177 | 650370410 |
| 6178 | 401647033 |
| 6179 | 2519377390 |
| 6180 | 387585450 |
| 6181 | 2534863417 |
| 6182 | 2508717089 |
| 6183 | 2508717089 |
| 6184 | 88791782 |
| 6185 | 639001563 |
| 6186 | 470888965 |
| 6187 | 2534778690 |
| 6188 | 443475069 |
| 6189 | 2504584696 |
| 6190 | 294807069 |
| 6191 | 647441155 |

TABLE 17-continued

SEQ ID NO. vs. Accession Number Index

| SEQ ID NO. | Accession No. |
|---|---|
| 6192 | 217415515 |
| 6193 | 643182375 |
| 6194 | 224023320 |
| 6195 | 644143684 |
| 6196 | 237715296 |
| 6197 | 646218740 |
| 6198 | 282900774 |
| 6199 | 647106526 |
| 6200 | 2508719616 |
| 6201 | 2508719616 |
| 6202 | 148643814 |
| 6203 | 640593578 |
| 6204 | 396584777 |
| 6205 | 2538587612 |
| 6206 | 458067975 |
| 6207 | MMU_RS00565 |
| 6208 | 410162335 |
| 6209 | 2532553935 |

REFERENCES

Other References are Cited in the Application

1. Labrie, S. J., Samson, J. E. & Moineau, S. Bacteriophage resistance mechanisms. *Nature reviews. Microbiology* 8, 317-327 (2010).
2. Stern, A. & Sorek, R. The phage-host arms race: shaping the evolution of microbes. *Bioessays* 33, 43-51 (2011).
3. Tock, M. R. & Dryden, D. T. The biology of restriction and anti-restriction. *Curr Opin Microbiol* 8, 466-472 (2005).
4. Chopin, M. C., Chopin, A. & Bidnenko, E. Phage abortive infection in lactococci: variations on a theme. *Curr Opin Microbiol* 8, 473-479 (2005).
5. Deveau, H., Garneau, J. E. & Moineau, S. CRISPR/Cas system and its role in phage-bacteria interactions. *Annu Rev Microbiol* 64, 475-493 (2010).
6. Horvath, P. & Barrangou, R. CRISPR/Cas, the immune system of bacteria and archaea. *Science* 327, 167-170 (2010).
7. Sorek. R., Kunin, V. & Hugenholtz, P. CRISPR—a widespread system that provides acquired resistance against phages in bacteria and archaea. *Nature reviews. Microbiology* 6, 181-186 (2008).
8. van der Oost, J., Jore, M. M., Westra, E. R., Lundgren, M. & Brouns. S. J. CRISPR-based adaptive and heritable immunity in prokaryotes. *Trends Biochem Sci* 34, 401-407 (2009).
9. Makarova, K. S., Wolf, Y. I. & Koonin, E. V. Comparative genomics of defense systems in archaea and bacteria. *Nucleic acids research* 41, 4360-4377 (2013).
10. Chinenova. T. A., Mkrtumian, N. M. & Lomovskaia, N. D. [Genetic characteristics of a new phage resistance trait in *Streptomyces coelicolor* A3(2)]. *Genetika* 18, 1945-1952 (1982).
11. Sumby, P. & Smith, M. C. Genetics of the phage growth limitation (Pgl) system of *Streptomyces coelicolor* A3(2). *Mol Microbiol* 44, 489-500 (2002).
12. Laity, C., Chater, K. F., Lewis, C. G. & Buttner. M. J. Genetic analysis of the phi C31-specific phage growth limitation (Pgl) system of *Streptomyces coelicolor* A3(2). *Mol Microbiol* 7, 329-336 (1993).
13. Makarova, K. S., Wolf, Y. I., Snir, S. & Koonin, E. V. Defense islands in bacterial and archaeal genomes and prediction of novel defense systems. *J Bacteriol* 193, 6039-6056 (2011).
14. Rudinski, M. S. & Dean, D. H. Evolutionary considerations of related *Bacillus subtilis* temperate phages phi 105, rho 14, rho 10, and rho 6 as revealed by heteroduplex analysis. *Virology* 99, 57-65 (1979).
15. Bondy-Denomy, J., Pawluk, A., Maxwell, K. L. & Davidson. A. R. Bacteriophage genes that inactivate the CRISPR/Cas bacterial immune system. *Nature* 493, 429-432 (2013).
16. Wang, L. et al. DNA phosphorothioation is widespread and quantized in bacterial genomes. *Proc Natl Acad Sci USA* 108, 2963-2968 (2011).
17. You, D., Wang, L., Yao, F., Zhou, X. & Deng, Z. A novel DNA modification by sulfur: DndA is a NifS-like cysteine desulfurase capable of assembling DndC as an iron-sulfur cluster protein in *Streptomyces lividans*. *Biochemistry* 46, 6126-6133 (2007).
18. Wang, L. et al. Phosphorothioation of DNA in bacteria by dnd genes. *Nat Chem Biol* 3, 709-710 (2007).
19. Gomez, P. & Buckling, A. Bacteria-phage antagonistic coevolution in soil. *Science* 332, 106-109 (2011).
20. Hall, A. R., Scanlan, P. D., Morgan, A. D. & Buckling, A. Host-parasite coevolutionary arms races give way to fluctuating selection. *Ecol Lett* 14, 635-642 (2011).
21. Makarova, K. S., Anantharaman, V., Aravind, L. & Koonin, E. V. Live virus-free or die: coupling of antivirus immunity and programmed suicide or dormancy in prokaryotes. *Biol Direct* 7, 40 (2012).
22. Makarova, K. S. et al. Evolution and classification of the CRISPR-Cas systems. *Nature reviews. Microbiology* 9, 467-477 (2011).
23. Sumby, P. & Smith, M. C. Phase variation in the phage growth limitation system of *Streptomyces coelicolor* A3(2). *J Bacteriol* 185, 4558-4563 (2003).
24. Bikard, D. & Marraffini, L. A. Innate and adaptive immunity in bacteria: mechanisms of programmed genetic variation to fight bacteriophages. *Curr Opin Immunol* 24, 15-20 (2012).
25. Hallet, B. Playing Dr Jekyll and Mr Hyde: combined mechanisms of phase variation in bacteria. *Curr Opin Microbiol* 4, 570-581 (2001).
26. Cerdeno-Tarraga, A. M. et al. Extensive DNA inversions in the *B. fragilis* genome control variable gene expression. *Science* 307, 1463-1465 (2005).
27. Terns, M. P. & Terns, R. M. CRISPR-based adaptive immune systems. *Curr Opin Microbiol* 14, 321-327 (2011).
28. Haft, D. H., Selengut. J., Mongodin, E. F. & Nelson, K. E. A guild of 45 CRISPR-associated (Cas) protein families and multiple CRISPR/Cas subtypes exist in prokaryotic genomes. *PLoS Comput Biol* 1, e60 (2005).
29. Stern, A., Keren. L., Wurtzel. O., Amitai, G. & Sorek, R. Self-targeting by CRISPR: gene regulation or autoimmunity? *Trends Genet* 26, 335-340 (2010).
30. Cong, L. et al. Multiplex genome engineering using CRISPR/Cas systems. *Science* 339, 819-823 (2013).
31. DiCarlo. J. E. et al. Genome engineering in *Saccharomyces cerevisiae* using CRISPR-Cas systems. *Nucleic acids research* 41, 4336-4343 (2013).

SEQUENCE LISTING (6236 sequences)

SEQ ID NO: 1 - DNA, 3010111 bp, Lactobacillus rhamnosus (residues 1-1,505,056 of 3,010,111)
atgcccaatttagaggagctttgggcttacctgaatgataaattccgtgaagagttgaccccagtcggttacagcacatggattcaaacagccaagccggtcaaattgacccaagataaactcgaaatcgaagtacctgcatctttgcacaaggcctactgggagaaaaatctggttaccaaagtggtggaaggcgtctatgagtttgcccaattagaagtcgatcctgtcatcatgaccaaagacgagttgcagcccgcttccacgcatcagcatcaagtaaccgatgacgatgatgaccaacaactcacctttaaggcaaaaacgcatttaaatccgaaatatacttttgaccgcttcgtgattggtaaaggtaaccaaatggctcacgcggcggctttagcagtagctgaggcgcctggtacgacttacaacccgctgtttatttacggcggcgttggcttggggaagacgcatttgatgcaggcgatcgggaatctggtcttggaaaataatcccgctgccaacattaaatatgtcaccagcgagaattttgccaatgacttcattaattccatccaaacaaaacagcaagaacaatttcgtcaagagtaccgaaatgttgacttgctgttggttgatgatatccaattcttcggtgacaaagaagccacgcaagaagagttcttccatacatttaatacattgtacgaaaatatgaagcaaattgtcctaaccagtgatcgtctgcctaatgagattcccaagttgcaggaacgtctggtatcccgcttcaataaaggactatccgttgacgtcaccccgccggatcttgaaacccgtatcgccatcttacgcaataaagccaatgcagaagatctcagtattccggatgacacgctttcttacattgctgggcaaattgaaagtaacgtccgtgatcttgaaggggcgctggttcgggttcaggctttttcaacgatgaagaacgaggacatcacaaccagtttagcggcagatgcactaaaagcccttaaactcgatgatcgtagcggacaactcaccattccgcagattctcgatgcggtcgccaaatattttcaagtcaccgttcaggatctaaaaggcaaaaagcgggttaaacaaattgtcattccccggcaaatcgccatgtacttagcacgcgagatgaccgacaatagcttaccgaaaatcggccaggaaattggcggaaaagatcacacgactgtcattcacgcccacgaaaaaatcatggctgccatgaccaccaacgaagatttaaaagcacatgtggtcgaactccgcaatatcctgaaaaatcgtggttaatccacttgtggacaactgccagaaacagaactttttgtccctatcacttatccacaggtgcataacttcatgatttgctgttccgcaaagttatccacagtttgaacacgccctattactattactctaaaagctttatattatatatataaaacgacgtacaggaggctcttatgaaatttacgattacccgatccacattcttgaaaaccttgaatgatgtttcccgggctatttcaaccaaaaccacgatcccgattttgacagggttaaaaatcgtgctcaatgatactggactagtgctgaccggtagtgatgctgacatttcgattgagtcaaccattaacgctgctgatgaaagtaacgatttacaaatcggcagcactggtgaaattgtgttaccagcgcgcttcttcagcgaaatcgttaaacggctgccagaaagcaccatgacagtagaagtaaaggacaattttcagacggtcattacttcaggagcttccgagtttacgattcgtggagaagatgcgaacaattatccgcgtctaccggaaattaccgcagatgaagccttatctgttccggctgatgtcttacgccaactgattaaccaaaccgttatcgccgtatccaatcaggaaagtcggccaattctgaccggggtgcatttaacgattaccggcgatcaactcgttgccgttgcgaccgattcgcatcggttatcgcaacgtactctgacattaccagcagcaagtaatatcgattacgacatcatcattcccggtaaaagtctgacagaactaagtcgcatgttaggtgacgatgtgactaaaatcgaaattcgcattgccgagaatcaggtattatttgtatttggacaaaccgccttttattcgcggttgcttgaaggcaattatccagacacaagtcgacttatcccaacgtccagcaatacgcaagccgaattcgatgcgccggcactgctggcttccattcagcgggcgagcttgctgagtcacgaaagcagcaataacgtggtgcgtttagtcctcaacattggcgagcaaagagcaaccatctatggtaattcgccagatgtcgggaatgtcgaagaagtcttaagctttaacaagctgaccggtcaggatctggaaatctccttcaaccctgattacatgaaggacgcgctgcaaggctttggccaaacagcgattgaagttgactttacggcaccgctgcggccattcaccttggttccaaccgaagataaagagaagtttattcagttgattacgccggtgcggacgttctaagcaatagaaaaacgcaaatacagagccaattaaaaaagattctagagcgcggtgaaaagctctggaatcttttttattgctttcaacgctgtgatcaaggtcggtgtgttgtatttcaacaggtaatcatcaaccgaccaaaatgctttgacaagttgatccataccaaggtgttatacccagaatcacgctaaccattagcgtatcaaatatattcctgcaactctgagtgtcagctcgagacacttatcacctaaaaacggctttaggctaggctaaaaacgataaaactaaaaatttggctgtttttgggctttctaagtgtttttagtctaggggggcgtcttaggctcaaattgcctcagagccgcttaaatgcccgttttgaattgttttttacttggtataagggtataattaatttgtgttcgttagcggcaaatcaccgtttctggtggtttgccgatacatttcggattggagggcgacgacgatgacaaccatcaagatcaccaccgcatttttgacattgggccagtttctgaaagaggcaggtttgattgatagcggcggtgcggctaagtggtatttgggtgagcacccggtaaccgtgaacggggcagctgaagaccgtcgtggccggaagctgtatccgcatgatcagattaaagttgccgatcagacctatgtgatcgtgagcgcatgaagctggatcatttaacgttaaaaaactatcgcaattacgcaacggtcgatacggcattttcaccggagatcaatgttttgatcggtgaaaatgcgcaaggcaagacgaatctgcttgaagcgatttatgtattggcgttagcgcgcagccatcggaccaacaatgataaagagttgattcgctttggcagtgattttgcgcgcgtctccggtcagatcagtcgccaaagcgggacgcatcagctggaattaattattagtcatcaaggtaagcgggcgcggattgatcggatcgaacagtcaaaactgtcgcaatacttagggcattttaatgtcattttgtttgcaccggaagatttggcgattgtcaaaggcagtccggctgggcggcgacggtttatcgacatggaatttggccagatgagtcccaagtatctttataatctgagccaatacaaaacgtttctaaaacagcgaaacgcatacttaaaacagctgaaataccatcaagccaaggatcttgtgtatttagacgttttgactgattcgttggcggcgtttggagccgagctgatcacggcgcgggcaaaattgctgcagaccatgtcggattatgcggctgccattcaacaagacattaccaagggacgcgaaaagttgcagtttgcttatcagactcaggttgctgcggatcttcgacaagatagtgaacaagtctatgaagcattaggtgccttgtttgcaaagcagcagtcgcgggaaatcgagcaaggcaccagtttggtcgggccgcatcgcgatgatgttttgtttattgtcaatgataaggatgttgctaatttcggtagccaaggccagcagcgcaccacggctttggcagttaagttagccgaaatcgacttaatgaaggatcagacaggcgaatatccggttttgttactggatgatgttttgtctgaacttgacgctattcgccagacccatttattgaaggccattcaagccaaggttcagacgtttctgacaacgaccagtctggatggcattcaaaaggaaatcatcacggcgcccgctatttttcaggtgcaggatggcgttttgacgaagcaggcgtgagcaactgtaaacgatacgaggaggataaccagtgacggacaagaaagaatcggccgaagaaaagaaagaagaactggcagcagaatatgatgctagtcaaattcaggtgctgtcaggactcgaagcggttcgcaagcgcccaggaatgtacatcggctcaactagcagtcaaggattgcatcatttagtttgggaaatcattgataacgggattgacgaagcgttggctgggtttgcaacgcgaattgaagttgaagtcaacccggataacagtgtgaccgttaccgatgatggccgcgggattcctgtcgacattcaggcaaaaaccggtcgtccggcacttgagacggtttatacggttttgcatgccggtggtaagtttggcggtggcggctataaggtctccggcggtttgcatggtgtcggcgcttcggttgtcaatgcgctatcaacgaatctggatgtgacggttgttcgcggcggcaagcggtattacatcgactttgtgcgcggcaaggttaacacgccgatgaaagaacttggcccggcaccggagcatgagcatgggaccaaggtccattttcagccggatccggatattttcacggaaaccacaacgtttgatgataaagtcctgacaacgcggattcgtgagttggcctttttgaataaggggcttaagctgacgtttactgataagcgtgcggcgactcatgaaaagctggtgtttcattatgaaggcggcttgaaatcttatgttgatttcctgacgaagaagaaagaaaacctgctgcaggaaccgatttatgtggaaggtcaggataaaggcattacggttgaagtcgcgctgcagtatacgaatgactatcacagcacgctgttgacgtttgccaataacattcacacttacgaaggcggcacgcacgaaaccgggtttaagacggccttgacgcgggtgattaatgattatgcccggcgttccggtgcacttaaagacagcgatgatccgctcagtggggatgacgttcgggaaggcttaaccgcagttgtttcggtcaagcatcctgatccgcagtttgaaggccagaccaagaccaaactggggaactcggatgcccgcacggtggttgatcgtaccttctccgatcacttcaataaatttcttatggaacatccggctgacggcaagctcattattgacaaggccatgcttgccagcaaagctcgcttagctgctaaacgggcgcgtgaagtaacgcgtaagaagagcggcttggaaatctccaatctgccagggaagttagctgacaacaccagtaaagatccggaaatttccgaattgttcattgtcgaaggggattccgcgggcggttcggctaagtcgggacgcagccggctgacccaagcgattttgccaattcgcgggaagattctgaatgttgaaaaagcatccatggaacgtattttggccaacgaagaaatcagaacgttattcacggcgatgggcaccggttttggtcaggactttgacattagcaaggcccgttatcacaagttgatcatcatgaccgatgccgatgtcgatggcgcccatattcggacgttgttgctgacgctgatttatcgctacatgcggccggtgcttgatgctggctacgtgtacatcgcccagccgccgttgtatcgcctgcgtcaaggtaaaatgatgcgttacatcgattccgatgaagagctacaggatattctggggcaactgccgcctagtccgaagccggatattcaacggtacaaagggcttggtgaaatggacgccagccagctttgggaaaccaccatggatcctgacacgcgccggcttttacgggtatcgccaaaagatgctgaacaagcagatggcatttttgaaatgctgatgggcgatcatgttgagccgcggcggaagtttatcgaagaaaatgcggtctttgttgatccgaacaacattgacgtatgatagatcgcttttaggatgcagacaggtaaaatgagaacttttgagaggagacttttcgcttaatggatgatcgccaagaaagccggattacgaatgtgaatctcggcgaaacaatgcgtaaatcattccttgaatacgcgatgagtgtcattgtggcgcgggcattgcctgacgtacgtgatggcctcaaaccggttcagcgccggattctgtatggcatgaatgaactcggggtcacaccggataagccatacaagaagagtgcgcggatcgtcggggatgtcatggggaagtaccatccgcatggtgacagctcgatttatgaaggactcgtccgaatggcgcaggactttagttaccggtatatgctggttgacggccacgggaactttggctcggttgacggtgacggtgcggcggcgatgcgttacaccgaagcccggatgagtaaaattgccgtcgaaatgttacgcgacatcaacaaagacacgattgattttcaggataattacgatggcaccgaaaaagaaccggttgttttgccagcgcgcttcccgaatctgctggtcaacggtgcgacagggattgcggttgggatgaccaccaatattccgccgcataatctgtcggaaacgatttcggccttgcatgtgctgatggatcatcctgatgccaccaccgctgacttgatgcaggcattgccgggacccgattttccaaccggtggcgttgtcatgggcaagtccggtattcgccacgcatacgaaaccggtcgcggaacgattgtgttgcgtggtaaagtcgacgttcaaactgaaaagtccgggcgcgaacggatcgttattaccgaaattccatacatggttaacaaagccaagatggtggaacgaattgccgatttggtccatgaaaagaaaattgacggcattgtcaccttgcgtgatgaatccgatcgtgatgggatgcggattgtcattgatgtccgccgcgatgccagtgcttcggttattttgaataatctctacaaactgacaccgctgcaaaccggtttttccttcaacatggtggcgattgtcaatggtgcgccaaaggtattgagcctgaaacagatcctgcaatattatctggatcaccaggaaaatgtcattcggcggcggacgcaatatgacctgaagaaggccaaggcacgggaacatattcttgaaggcttgcgaattgcgcttgatcatatcgatgaaatcattacgattattcgcagttccgaaaccggcgataaagctaaagtcatcttaatggacaagttcaatctgtccgataagcaaagtcaggccatcctggacatgcggctggtgcggttgaccggtctggaacgtgacaaggttgaaagcgagtataaagatgtggaggcagccattgccgactacaccgatattctggctaaaccggaacgtgttcaccagattatttatgatgaattgctcgatattcaaaagaaattcggtgacaagcgccggactgaactgctggtcggtgaagtgctgagtcttgaagatgaagatctgattgagcaagaagatgtcgtgattaccttgagtcacaacggttacgttaagcgcttggcaaccagtgaattcaagacgcaaaatcgcggtggtcgcggtattcaagggatgaacgtccatgacgatgatttcgtcgaacacctgatttccacgtcaacccatgatgttttgctcttcttcaccaacaaaggcaaagtttaccgcagcaagggttatgagattccagaatacagccggacagcaaaagggatcccgatcattaacctgttaggtgttggcgcgggcgaaaagattcagacagtgatcaacgtccacgaaggcgacaatgatgatcgctatttattcttcgtcacccaaaacggtgtagttaaacggacaccggtcaaggaatttgccaatatccgcagcaacggtctgattgcgctcaacttgaaagatcaagatgaattgaacaatgtcattttgacgtctgggcaggataacatcttgatcggcacgcacttgggttacagtgtggcctttaaggaacaggatgttcggtcaatgggtcggacagccaccggggttcgcggcattcgccttcgtgatcacgattacgtggttggctccgatatccttaagccagattccgaagtctttgttatttccgaaaaaggctacggtaagcgcacagctgccaaggaatatccgattaagggtcgcggcggtaaagggattaagaccgcgaatattactgagaagaatggtccgctggcaggggttacgacagttgacggcaccgaagatattctggtgatgacagactctggggtcatgattcgcttcaatatccaaaatgtgtcgcaaaccggccgggcaacactaggcgttcggttgattcgggtcgacgatgatgccaaggttgcaaccatggctaaggtcgaaccggaaagcgacgatccagatgacagcagcaaaccggatcagccaaccgatccgcaagccggaccaactgatgcacatgcgcaaccggctgacgggcagtatgcaggcaatgccgatgaacaggttaacaaactgttagatcgttcggagactgataaacctgcacctgatgatggcgatgaagcctaactgaaccaagatgcgttgaagcgtcaatgaaaataccgttcgaatgggtagtttgccagttcgaacggtatttttgtgcctcgtttttcacgcggctcgtagcttgctccccaaaatttttgatcgctaatccatttacgttaaacatcatagttttgacataatgtatagcagacagtgaaaaatagagcgatgagatttgaggggaagagttatcatgttaaacaatgtgagtttaaccggccgtctgacgaaggaaccagaagtgtttaaaactgctgctgatttggaaccagtgcgctttacgttggtagtgtgagcaattttagttgaaaagcacaaaataaatataatgatttttagttattttttcttttaaccatatgataaaacaccgctgcagcgattccacctatcataaggctaacaacgagcgcaacagggtttaaccagttgtttggactgacgaagatgttaccatataaatagatcaggattgaaaataaaataaatataccaataacggaatttttgttttttgcatttttcatagtgtttaatctcccttattagactgtaatatgtattataaagatttttttggaaagaaaagcgtttacaatattttattaagatgttagattaatacataggaaaactagttttctaaaaaataaagaaatggagcgaatatgatgacgacaactcttagtttgtacgatgccttaggtgaggatcaactccaaggtatcaatggtggccgtggtaaatgctcagcgaacgaagctaataaagcaatgggaaatgcttttgttggcgggttcgttggtggacttcccggtggattcctcaccgctctgggcgcaggtggagcaggtggtttagctacgggagcgggttactgggcgacatgctggtggtaaggtagtagacctgccggatgcgaaaaagctgacacgtatttgtgtcagcttttttagaagaatgattaaaaaattcaaaaggagtgaaactcaaatgaaaaaaatcattaaacttgcaatggctggatttatcggaataataacctttactctactgttgaatcctataagggtatctgcacacgaagatgccgacataccccaggtaacagaaaaagaatatttaaacaatataaatggtgtgaagcagattgactctgatcagtacttggaattagtcaatagtggggatgcttcttctgattttgtcgtttattttggttttaaggagtgcccatactgtcgagcagtttctcgtacgctgaagcagtttataagtgaggctaagcacccaatatactatatgaatatggacgagagtttcacggagacgacagctgatgactataaacaaattctggaatcactcagtccgtttaagtttcatggaacaccaactttcgcttatttccataataacaagatacgtaatatgttagttggatatccaattacacttcagcaattcacgcaaacagaagtaagcgttctgaataagcaacaataattatgctgggtggtatgaaaggctcactggaaatatagattttgacattgacttttgttttcttgattatttaggttctcagttggtctcaagatctgtgctaaggttattgcttaattctttagaaccgtttcaaaactacgtgggttgcatcagcatgtaaattagtatggtcaatcatgcgactgaattgatctaacgtataagcgggcatcgtaatccctccaaaaattgaattcgcttacatccagcatagcacgttttgcgtaatgtatagcagacagtgaaaaatagcacgatgagatttgagggggagagttatcatgttaaacaatgtgagtttaaccggccgtctgacgaaggaaccagaagtgtttaaaactgctgctgatttggaactagtacgctttacgttagcggtggatcgggtttttaaaagtaaaaccggacaacgggaaaccgattttattgagtgcgtgatctttggcaaacgcgcactgacatttgccagctcgacaacaaaaggctcgttgatcgggattgccggccgaatcagcaataatcatttcgagaataaacaaggcgaacagcagtggcggacttcggtagtcgtcgataattttgcctggctggagtcgcgtgccatgaccgagagtcggcgtagtggctccatgcaagcgaccggaactgacggtatgccaccgggggcaccagctgaaccggcagaaattgctacggatgatttaccgttttagtagtagtaatcgccggagatttatgctacaattttaactcgtgagtatccggctatttttgtagccttattactccttgctccggcaaacgaccggggcctaaagtccacaaggaggtgaatcgtcatggctgaaaccaaatatgaagtcacttacatcattcgtccggatctggatgaagctgcaaagaccgaattggttgaacgttttgacaatattttgaaggaaaatggtgccagcatcattgattccaaggattggcaaaagcgtaagctcgcatatgagatcaacaagtacaacgaaggtctctatcatatcgtgaacttgtctgcagaagatgacaaagcgatcaatgaatttgatcgtcttgccaagatcaacaatgatattctgcgtcacatgatcgtgaagcgggaagactaattgtaactttttgaaaggggcgctacggcatgcttaacagtgttgcattgacaggtcgtttaaccagagatgttgacttgcgctatacgcaaagtgggacagctgtcggttcattcactttggccgttgatcgccagttccgcagtgcaaacggcgaacgggaaaccgacttcattaattgtgtgatctggcgtaagtcagcggagaatttcgctaacttcaccaagaagggatcattggttggtgttgaaggtcacattcaaacacgtacttacgataatgcgcaaggacagaaagtttatgtgactgaagttgtcgttgaaaactttgcgttactggagtcacgggcaaccacccaacagcggccatccgaacctgctaatcctgcaggtcagggaaatcagaactatggcgggggacagcagtttggcaacaaccagccgcaaaatccgcctagctttggctctcaaggcgccccaagtaatgcaccatcatcgaatccgggacaaaacccggcagcaggtcagaaccaaggtaacaacggtaatgctgctaatcctgatccatttgccaataacggcaaaccgatcgacatttccgatgatgatctgccattctaacgtttgacttttggtcatactatctagggtaagggatgcatattaacccccttactcgcttggaatctttgatagagaaggaggaattctcatggcacaacaacgccgtggtggccgtcgtcgtcgtaaagtcgacttcatcgccgcaaaccacatcgaatacatcgattataaagacacgaatttgttggatcggttcatctcagaacgaggcaagattttgccacgtcgggtaaccggcaccagcgctaagaaccaacgtaagctgacgatcgcaatcaagcgagcgcggattatgggtcttctgccatttgtttcagaagactaatcaagtatttaaaaaggatgttcccgctaaaaagcaggagcatcctttttttggtgagcgcgagccggcgcgggtaggtatcggagtgtaagcggccttgagcgtgatggccgggctttggccattgcgctcaaggtccttacacgcagatccctgcgccggggagcgcgttatgggcgtaaaccagaacataagcggccttgagcgtgatggccgggctttggccattgcgcccaaggtccttacacgcaggcttctgggctggcgaacgcgttatgagcgtaaaccagaacataagcggccttgagcgtgatggccgggctttggccattgcgcctaaggtccttacacgcagacttctgcgctggcgaacgcgttatggaaaaatttaaattattttaactgggctaacattgcctgattgaattccggcaagtcatctggtgtccggctggtgaccaagttgtggtccacaacaaccggttcatttttgacaatcgcacctgcgtagtacaagtctggacgaaccgtggtgtaagctgtcatcgtccgccccttggttaaaccagtctgaatgaagaactgcgggccgtggcagatggcgaaaaccggtttgtcatctaacaagaatgctttgacaaagttaacgaaccgatcgtcagcacggagctcatctggtgagaacccgcctggtagcagcaaaccatcaaagtcttcaggtttaacatcggtaatcgttgtgtcaatggttgccgttgcaccatgcttaccggtaatttgtttacctgcttgtgtttcaatcaaggtcacatcatgcccctgatctttcaaagccttaactggtgaagtcagttctgcatcttcaaagttatcggtaacgagtacagcaatttttgccatcgaaatagctcctttcaagatatattactaatttagtttaacggattgaaagaattcatgcaaaatatagaaatattaatgaatatcgaacgtctggcagaacgagatgcttgttatggcaaacatgcgttattttgggaaggcgttaagaacaaacgatagctaatatatcagtgttcggtagtgcttcaattgcatataaaatcacaagcttatcgttatataaaaatttgatttggttctacaataacggtgatcaggaggacaaaatggtatcatattaggattttgattatcagaggtgatcaaaatggggctcacattagcgacggttccactagcggttacgaatttatcgcggatgcagtttgcggtgaccgccatcacgcattttctgtttgtcacaacgactgtcggcatgttgctgacaaccatgatttttgaatttttatatgcctatggccgtggggatacggaaaagttcggtcggttgacgctgttctttagccgaatcttcttctttagtttcggtactggcgttgtgaccgggttgattatggaatttcagtttgggatgaattggtcggcattcacacggttgatgggcgatgtcgctggggtatcgttggcgattgaaagtatgatttcgttcttcattgagtcgaccatcattggcttatggcggtttacttggggtaaattgccaaagcgcgcccatgcttggttaggtgttggcatgttaggggcatcgctgttttcagtggtttggattattgcaattaatgccttcatgcagaatccgtatggctttcacttggaaaacggccgcgcgcggttgaatagtttgattacgttgctacagaatccgcagtaccagccggaatttttgcatgttttgtttgccattctgatcaccggcggctttgttacagcaggcgtttctgcttggcagattctgcataaacgggatacagcggcgtttaaaattgccgtgcagatcgggttgctcatcgcgttgccagctgcctttttacaaccggctcaaggcgatgatcaaggagccgccacggcagcgttgcaacccatgaagtttacggcgattgaagggcgctacaacacggaaggcagcgccacaactggggcaccatgggcaatggcagctttgatcaatgaaaaggatcggacggttaaggcagtttctattccgaatttaggcacttattttgggaagaatacttttaccggagctatgccggggatgaacgcggttgctaagatgtaccacgcgaagttcgataagacagttgctaagtcttacgatgggcagatgaattattatccgccagtcactttgctgttttggacgatgcatctcatggtttacgcgggctatttcttcacgatgtttgctctttttgccacgattatgttgcatcggcgcaagtctggcattgaagctcaccctaagacgttgcgcgctttggggtggacattatggctgccgtacctgacgtttacttctggctggattgtggctgaagtcggccgttatccgttcgtggtttatggtttgttgacgcaatacgatgcagtttcgccaagtctcacggttactgaagcggcaacgagtctagccatgtttttcgttgcggatgtgttcctggttagcaccatgatttatatttcgcatcgaacggtaacgcgcggactgccggagattgacggtaattatctggaagaacaccaaattccggatccatttgccaaggaggcgttcagtcatgcctagtctttcgaatttacaagtcatttttcttgggattattgccactgagctgatgttgttctttgtacttgatggcgctgacttcggggccggaatggcgaccttctttgtgggtgatgatttagccaagcgtcaacaaatcatgaaggtaaccggtccggtctggggtggtaacgaaacttgggcagttactgcctttgccgtgatgtttgcggcgtatccgggctggtattcggcattaacatccggctattacccgctcatcttcctcatgttgttctttttaatctttcgtggggtggcgtttgattatcgcaatcaatggcacagtcgccactacaatcagttttgggactgggcactgtttgttggcagtttgatgccgccgtttttactcgggatcgtgtttagctcgacagtcagcggcgtaccgattcgtaatggcttcgtctatgccgggatgggcgatattctgaccccgtttagcctattgggaggtattttagtcgtcttgttaagcttgaatgtcggtttggcccgcgtgattaaaaaagtcaaaaaagacgttgcggttcagttgacagtggccttgaagcgcacgacttgggcactttatctggcggttggcgtatttgcggtcttgctgccatttaacacgcgcttcttcaccaatcggccgggtatcgtctcactcctgttgctattactgattgtgtttcttggtgttgaaacttgggcgatcctccgccagcggcaacggcttgcgttttggttaagcgttggaacgatggccagctttatttacacgattttccttggcgtctttccaaccttaatcgttggccgcacaccggggacttcggtaacagccttaagcgccaccagcggcccagtttcgctactgtggacggcatggttatttggtttcaccatcatattaatggtcggactacaagcgacggcctatcatttgatcaacaaatattatcatgaaccggcatcaccaatggtttaagcgacacaacaccgcgttcatggcaaggaggcgcgagggatgaagaaaatctggatcaacgtattttggggtctgttggtggtcagtttttggttgtatcaagtcttttggccgctattctggaacccgatcagtaagttctatggcatggtcgttttatacagcattgcagttgttgcattaggattggcgattcgcgcaacggtgaaaggctatggacgacaaaaagtttgaatgagaattttattgacgtcagcaaaaaaggtctctaactaaatagcggcctttttgatagcgtcacacagcggtatgttaaccgagttgatagtccttaacctgacgatgcaagtctttaaattgttggcgataatgccagacgacaataaggataagcaaggtgaacagcagcaatgtaatattgcttcgctcaatgccgaatatgccaccggttagccactgagcggaggtggttggtactgacctgaagaaaaggtttgtttcggaaaagcctaataccgatgtgccaaagaggatgcctgcagagatgtgccaagttgcatgaaatagcactgcaaagccaaatatttccggaaaggagccggatttcagacatcaaaatactaccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgctacaattcaggcccttcaggctgctggtgacaccgcgaccgtgattgcacagaagcttcatcgcagtaaagcgacaatctcacgagaaatcacgcgtggatctgtaactcagctcgactcgaagcgtcactcgcatcaagtctatcttgcggaaactgcccaagccatgcacgaccgtaaacgcgatagaaccggtcactacgcctttcttaagaccggccgtgcgttcttcaaggctctcgccagggagcttactcgtaagccgcgcgtacacagcgttgatagcttcgtacacttctatcgcgaccagggcaaggcttgcccttcaacgacaactgtgtatcgctacatcgacgccgggctgcttgcgctagacaacatgacacttcccaagaagctccgacgccgcatcaaaggctataagaacgcccacaagcgcaagaataagaagatatacggcgactcaatcgagttgcgtcctgcggccgtgaatgaccgcacaggcgtgggacattgggaaggcgacttggtcaaaggtattcgcttagctgatgagccagcattaatgacgctcacagaacggtacagccggactgagatcatcgtcaagattcctgactatcatgcggacacctgccttaaagccttgcaggacacgatcgacgactacggggccaaggaatttgagagtatcacttttgacaatggttccgagtttgccaagttatcagagattgttggaacccagatttacttcgcacatccgtactcgccttgggagcgtggcacaaacgagaacgccaatggactgcttagggaattcttcccgaaagggaagtccctcagagcagttaccctggttgaaattcaagcagtccaatccgcactgaaccatcgtcccagacgtattctgaactatcttcgcccatgcgattactaccgatgcatggcgtaacagcctagaccactatcaagaattcgttatcatcgttgcacttgacttgaaaattgaggacatcaaaatactaaacaggaaaagattcaaaccggcgtgccaatcaggctcaaagtttacggaatcaaataagacaacaaaagaacctttatcctttacggaacgaatagataaaggttcttctttcaagaaagatgaaagggtgtagtaccttggaaaatttgatgaggatttcccattatttgtactcgtttaccccctgtagcaacttgcttagggaaatagttcgtcccgtacaataaatctaccccattctgcttgtttttggtgaaagtttatttaaacgtcgcgaattcggcaataatcgttaaagtttcgcctgaaatgacgtttaatggccatttcacgacgtttatctgtcagctattgacaaatgctgataaccattcgtatcatttggcaggcgtatttgatgccgagcgtgggcgctgatagatgcctgcagttgttgcggtgaagcatctgccggtaccctccaaatacgaaccaagcccatcaatcgattggaagattgacgttcgctagatagccgaatccatacatgatgctaactgaaagcagagcagaacaagtgaggcaagtaccaaactgagacgttgccaaacatgagaggttgggaaaagctgcagaatgaggatcagtatgatgactgtcattcttgtttcgaagagtgtaaatataattattatgataattttgaatatttttcaggaactaatcgtttgtgatagaggttgaatgtgtataagaagattcggcaattataatagactgtcagttgcaatgatagctcttgtttgctatcaattgccaatgtaaaaatacagcgataatccctgtaacgacaagaatagaaaaatcttcagaggccatatcttgataccgactctttttttaactattttgaatggtagatttatctaatgactgaatagttttttgaaattaatgaaatagacaaaggagcgctagtttgtgaaatatcaagaaagttcccttatcagaagaagcttttatatgctcgtattatatttgttgagtccatcacccctactttttttgctgatcatgccttacacaaataatgtagtatcatcgctttcgctggcatttgcgtgtgttacgtcgagtgtcgtagtaatatatatagcgtataaattgtttcataaatacaccaatcaaaaaatcattcagcgggttaaactgagagatattttttacgtgattggtggctatctgaccattttaattagcaatgaaatcctgacaaccttgaattatacgatttatcagcgggtacaaacgtcaaataatcaggtcattgaatcatctctgttaaatcacaatcaacttatggttattcttcttgctattaacgtgattgtattgggtccaatcacggaagaattggttttccgaggaatcttaatgcatttattctttaagcaaaatcagttattttttaaagtgctattgagtgctctcatatttgcttctgcccatggtggcgatacgattattggattcttgatgtacgttgttaatggagcagtgtttgcagttgtctactttaagactgggaaaatacaagacacgatcgcccttcattttgttaacaatattgttgcggtatcgacaatattatttctgtaattggtaactagctatttttaaatatatgaggttcaaatggtactcaagccaatacataccaatactttaaaagcgattcatatgtctagggatcttaaatttaaggttcttaaaaattcttgaaattcaacattttattgacattcaaattttataagagtaaattacacaatgtaaaatttagctatacctaaaattttgggggacaatttttatgcaacagttggcaactaaccggtcggaatagaaacttacggaaaaggatctcatgatggtatctggggtttaatgcagggaattaccggaatcgtccctaaaggctctaagttctgaggatggccttgtagtcaccttgttgatgacgaggccattttcatatgtaggtgaataaatgaaaaaagaaccattagcatccaagatctttgttgtcggggtcgtcagcttcggctgggcattcatagcacagatagttccaactctcatgggtatgtttggtactgataccaaccttttgattaaagaccctaaatagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaacccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaataagggttgcacttattatacgccgaactattggtaaatcctattattaaagtacttttatagtttttcaccatccactaaatatcagctattatttctatatacagaactgatcggcattttaagcatgtggttttactaccatgatgacgtcattttagttccattccgaggaagaaaaccgatcagaagttatctgaaaggctgggtttttggccttttcctgttcttgctagtctggggattgattgtcactttgggtggatacgatatacatatcgttttcgatgtctctaacctcatttggcttcctttatttctctttggctttagcatacagtcaatgtttgaagaacttctgtgccgaggctatgtaatgggctactggataaaagaaaaacgtcctgtattagcagttattataaactcaattcttttttcttctttacatattgctaatccacacttcgattggtattctgcaatgggcctatttctatttggagttgtgatgtctgaattgcgaattattaatcataacattctaatgtgcggcgctgtacatgctgcatggaatttttttgaaggaactatttttgggactacagtttccgggttgccaaacatagggcttgttttcaaatcaatgaataagacgacatctcaaatgttaacagggggttctttcggtatagaacgtagcggcgtttcaattcttatttatgctgttttggctatcacattggcaataattattaaaaagagaaaaacgccagaatctctttcgtcgcctacttatttacaagcagatgatgtctaaatatgacaacatctaaagagtgaaagttaaatatccgtagaagtcccgagaaatcgggacttttcggcattaaaaaagacgcaaaggtttctgcgtcgtataattaattcgaccaaaaccaacatataagggaggctttaagtacagtcgactacagttcctcccgtacaataaatctgccccattctgcttgcttttgatgaaagtttatttaaacgtcacgaattcggcaataatcgttaaagtttcgcctgaaatgacgtttaatggccatttcacaacgtttatctgaaatgtttgctgattaccattcgatcatttggcaggcttatttggtgctgaacgtgggcggtgatagatgcctgcaattgttgcgatgaaacatacgccggtacccatcaaaacgaaccaagtccaccaagcaatggggatgttcatatcggctagatacccaaaaccatacatcaagacaagctggcaactgcccaaaatgagggcgcagcaagctaagctaagacgctgccaaattgttgtcatcgaccaaagccaggcgctgattgtcactaaaatctgtacagcaaagattaaggccatgagtagttgcaaaatcgttcttaaataagccgtgatgaccagtcctttcaagatcaataagcattgcagtagaaaggcgcgaatccattcgtaccagaatgctaattgtaaaacaaatacgatagcagtagaaggagttcgccctcatctatagtacgaccaatcatctcagtaagaattgtcaataccagacttcttactggatcgataaattctttgaaaagcgagatggcctacatacacgtaaataagggactgaacacagagcagcaagaaagtgtttattgaaacgctgtgctggttgattaattgctttgagagatcgatcccaagggtaatcggcaacattcttccagaaatctgaacaaactcaggtaattgcgttaatgggaaaattgaacctgttaaaaataataggagatacgaaataaccgactgaaaagaggcggtttttgtatacttcagtgttaaagcggcgagcagtaaggagaagccaaaaattccaatgcaagtaatgaaaaagatcggtagtagcccgatatgaaatcctatgttcaagtgaaatatgaaggcaataaatgcaaggacgatgaaaactttaatgaagttaatgatgatccaaacggttgtttttacagtgagaactaactcaagtccagctggtcttagcaggagttggtctaatgtgcccatttgtttttctagagaaatactttcagaggcttcaccgataatcgaactaattagtggctggtgaaagcagcataactgcaagctttattggcatcaaagaatagtaaagattataattagtgcaaagtaaacatgggctaacgcctgttttccttgcactttttatttttcctggaggaaaccatcatggcttatcgacatcgtgctacccaattgtcatttcaatcctttaacaacggccttggtgtgccactctcttccgacaatgagtgggttcaattagccgacatgctcccgtggcaacagctcgatgaagcctatcaacttctttttactgagatgggtgggcgcgctgctaaaccctttcgtctgctttacggtgccagtttgatcaagcaagcagaacatctaaccgaccgttcggtcgttaccgctattcgtgataccccggcttaccagtactttatcgggctagacacctacacaaccgacctgccgttcaaccactcaaccttggtttattttagacgacgcatgggtcaaataacggaactagtgcgaaatatcatcagtgataccttgcgcgaacaaattcaaagcttattgccagatgatgagctccgtgtcttgatcacagacgctactgcggtgccaattgaaattcgttttccacaagatacttcgctgctaaatcaagctcggctcaatctagaagaaatgttattagacatggctcatcagttgcaaatcaagcctccacgaacctacaaacgtgaagcaaaagctaagtggaccgcttttgctagaaaaccgcggcgttgggctaaggaaacacgcaagcagatcaaagtacagctccagtatgtccgacgtgatctacgttatatcgatgtgctgttggcccacggtgcctctcttaacgaaaggcaaaccaaacgattggctgtgattcgtgaactttttgaccagcaaatgttcatgtatgaaaatcggacccatcgggtcccaggacggattgttagcttggcacaaccgtggattcgcccgattaaccgtggtaaagccaaacaacgaaccgaatttggtcccaaaattgatgcttcaattgccgatggcatgatcgatatcgaacgatttgattttaaggcgttcaatgaaagccaagatttagcaacaaccatcgatcattatttcgacgtgcatggttattatcccgatgaaatcttagctgacacactttatcgtacccgcgagaatcgtcagctctgtcaacgactaggcattaggttgtcgggaccacgtttaggacgtaagcctaaaaagatggatgctaagcagcggcaaattgatcgtgacgcagagaagcggcgcgggaaaattgaacgcggttttgccttcatgaaaggccctttgggcctttcattggtgcggactaaaacggtagccagcatcgcagtgacgattgatattgcgatcaatctagccaatctaaagatgctattaaggctttttaatggaccaattttgatttttgtaaaatataagcaggaatccatcttaattcactatcaaattcacgtttcaggtagccggaatgttgcctaattcaccagccactaattagataccagtaggcatacccgatataaaaagcagaatttccagcatcaatattaagaaaagtaaagactacaaaaatgagtacagtgacgaccatactggtaatttgatcagggaaataagttctaacttcggccagatatcgagaaaattcggctttaaataaatgtatgatcaagtcttccactccctttctcgatcaaaagactaaacgtaaaagttcgtcaagcgacggataacgattttgcaccgcatgaacggtaatcccatgctcaagaagctttttaaggaattcttgttgatctttcaatgttttgaaagttgtcgtcacacgctttccgtcgtcgcttgagttgacggttattgcattgttggctttgaaagaaaaatgggatgaaactacaacgaaaccaaaagaagaaaaggttttttggaattcttcataggggccgaagaatcgtactttctggttatcgataagaaggacatcatcgacaagtttctcaagaacatcagcttggtgtgaggtaaggataattgtcttgtgcaactgctgattgatttcctttatctgcctgattagcgtgcggctagcaacaaaatcaagtccaagggtcggttcgtccaagaacagtaagctggcattgctgactaaacaggaaatgagcgctagtttttgtttcattccccgcgagtactgaccaacgcgctggtcaatggcagatgaaagatcaaactttttgaaaagtgaattaatctcggaggttttgctggctggagaaataccgctgagattcaaaaagtagtttatattttggcgtccagttaaatagtcgtaaagattatcaacggattcaagaaccgctgccatgttacgataaagcgctctgtttccgtatgggatatgcttattttgaaaagtataatctacagtgccgcttgttttatcaatcaggtttaacaatatttttaatagtgtggtttttccagcaccatttttaccgagtattccggtgattcgccctgcttgaatcgaaaaactgacatctaagagaacggttttgtcttggaattttttgtttaaatgattcacattaatcatgttcatttgtttaatcctttatcatggcgagaatcagtgggacagcccttcttttaaactcatttttaggataatgaaatgttccagactttcgtttatggggacaacccccaagcaaactggaaggaaattaggttaaacactaatggaaaagggatagggtgttgtttgagttcgttgagaagttcagatatttgggatcttctaaatacttttctgctcatcagtaaaagtattttatcaaatatataaaacgctttcaacgatattagcggcggactgtaatttttgctgatttacaacaataatgaaaatcagaattttgataacaacaataatagcgataatgtgaaatcatgtaccgtgtttttaaacctgctgaaaaatccaataagggcgggcttcgtatccaacaagaaatgctggtaacatacctgcgtgcgatgtatttcagcatctttctaaaatattaattgacaatgttgttcaacaaatgctaaggtgaaaatcgcttcataaagcgtaatgattacgatttaaggggcgagattgcttttatatcaaccaagcgggtactaactggcgctgtatatctgtagaagcaatgagtccttgttggccgataaagaaatacaccatactgcgttgatcagttcgctagctttgtttgaaaacactggttaggaaccaaggctactcagactgaggcggcttatccggattggttgacgctaatgagggggttattcatgtttgcacttgtttgtttcttgatcatgttgccgatgatctttagtgtgccactgctgtatgtcgggatgttgccacgggttcgccagcaatcagcacttttaaccatgagtattgcgttaatgattgcgattgtctgttggttggtttttggtaaccgcctggcatttggttttgacttattacatgcagcaactttttcatcattatctgctggcttggtacaaatggatttttacttatatgcggttgcgatgttgatgggtacgatcgctggtaacaggaacagccgctacatgtttggctttgttccggtgtggaccgtgttggtgtactgcccgcttgcacgctggctatgggctgatcatgggtggttgcgacagttaggcgctttggacttttccggcggcattgtcgtgcatttgacggccgggttgacgagtttggtgctggcaaaagcgttacttccaggtgatcagccgagtatgccaaatgattttcgaactgattacgcggcaacgatcatgattctggttggctggttagggtttaacttagccccggcaggcagtttgaatgagcttgccggacaggtgctgattaatacattcgtggccgtgttgatggcgataatcggttggtgttggctgacttatcggcaaaatggtgtggtgcagttaggcgatttgttgaatggcgtgctgtgtggtttggtaaccagcaccgctttagtcggatacgtcgggacattgagcatggccattgttgctgccgttgctggcgtgatttgtcggcagatggtttcaaaaatgcagcattcaaaacatttctatgatgcggtagattcttttgcgatgaatgctatcggtggcattacaggggttgttggcttgatgattgtccaattctttaatgggactcatacaatagcgaccgcggggaagttcgcagtggttgaacttttagctgtagcggtcgcggctgggttgacagttattggcacaatggttgcgcagttagttgctagggcgtgtgaagctggcgtaacacgggtgatgaatcttgacagtgaacggttgaattgacaaagggagcgatttggatgaatcaaatgatgattattggtggtggagcagcgggcgttggtatcggtatcatgttaaaacaacttggctgcagtcaatttcagattcttgagcaggaagaaataggcgcgagtttccggcattggccaaaagaaacgcgattcattacgccatcctttaccagtaacggattcggcatgccggatttgaatgccgtcagtatggagacctcacctgcgtatacgcttggtgcagagcatctgagtggttcacaatttgccgattatcttaaattattggcggatacttacgcattaccgatcgctgaacatacgcgcgttggtgcaatttcaccgactactgaaggttatcaactcgaaacgaatcacggcgtcgtgaccaccaagtacttgatcatggcagtcggtcagtatgctttccctaaattaaccgatcatccggaaaacgtcattcactatcagcaagtgacctcgtggcaggatttgacggggaaaacccagattgtggttggcggaaacgaaagtggggtcgatgcggccatcaatttggctacgctaggccataaggtgcttttgttgactaaggaaacgggtctgaacgcggcatcgcctgacccaagtattcggttggcaccgtacacgcgtcggcgattcttggatttgccagcggaagttgctgaaagaatcacgttacaagagaagattgcgttgaagactgtcacgcgcacccaggattcccagtatcaattgtggtttacagacggacgtacgattacgacgccgtataagcccgttctatgcacaggttttgatgccggcccgttaaagctatggccacaattatttgaaaataatgatggcgaaattgctttgaatgacgttgatgaatcaactcaggcgaaaaatgtatttgttgccgggccggatgtacgccacgaggatgcgattttctgttacatttacaaattccgtcagcgtttcggagtgatcgttaatgagatcgctaaacgggaacagtgggacatcggggactttgtcaaaatcagtcgcgccaatagtttctaccttgatgattgtgcaacttgtgatgttgcttgtgactgctgagggagcgggcatttagaggaggaagctttcatcttaagtcagtaaaatggcaacgcccacttccattaagttacttttgcgtcaatacacataaaaaataaccctctgaacatgtcttcaaatgacagttgttcagagggttatttagttcaacggtatttttaggttgggattcattggtgaggtcccaagacgtgacattaagggtgggtaaaaattaccggtggatgtaaacgtagctgctggcaccagagatggtctgggtgttaggaccggttggtgagctgaagcccatgccgccttgagtgatcgtaacgctgtcgccagaaacagattgaacataagcaacgtgaccataagagccatcagctgtccattggccgccaacagattgaccagcagcgaagacgatgatggaacctgctgccggggtgtggttaaccgtgaagccggctgctgcagcggaagcgccccattcagcaccgttgccccagccattgcctgcccatgaagcaacagacttaacgtaccatgtgcactgaccccaaggataagtgttacctgaaccgctgtaatcagcatggctgccgctacctgaagcagtgttgctgctgatcacagtagatgaggcaccgctgttggaagaagtgttggttgatgaggtaccagtcgaaagaacactgctgttggcactcttatttgaagttgagctggtagaacttgaagcagttgatgcagctgctgtcttcaaggcagcctgggttgctttggctgcttctgattgttcttgagcaaattgactttggagtgcaaccaattcgtctttgtgatcagcaatttctttgttcaaagcatcttgcttatcgcttgcggtcttttgaagggtctctagctgtgacttttgcgtttcaagagatgctttagtcgaaaccaaggtctgacgtgccgtttcctgttcactcttcaaagcggctaacttatctttggcgacggttaccgcatccaaagcgtctttgctggcttgacttaacttgccgactgtcatggtacgggcaatcaagtcagatagactttgtgagttcaacacgaaatcaatatagacattgccgctaactgaactgccggctttcttttgaagggaaatcaattgatccttcaagttgttcttccgggctgcgacgttcttttgagcagcggtgatttcgccactcaacgatgcgatcttggcatccgttgcactgatcttggcagtggcgtcactgatttcgccattcttagcatcaatctgtttgttgaggttgatcacttcagtgttagctgcttcgatttgctttaataaatcgttggtttcgctcttgttagatgcgatgctggcacttgtgtcagcgaaaaccggtgttaaggcgctaacagaacccgctaaggtaactgctgcaaccaatgtcatcattgctttattgaatttcatgtttgacctcactcttaattaattaactaaaggctactttactgtgtcaatgttacgtcaccattacaggattgttatgagttgttctcaatcttcatctgggcgtcaaatttgcggcattttgagcatttagtggcgatttttcgtgaattttacatgaaaaaagcagccgcgatccgcgactgcatgacaaaattgtaagttactcgtttgatttcagtgcctcgaccatatccacacgttgaagtcgccggtgcgtaagccaggtgacaataccggtaaaggccatcatcaaaagcgtggctgtgagataaccgatcatactaatcgtcaacgggaagacaacggcctcggtttcggcttggaatagaatatagacggttaaaagattacccagtccatagcctaacaggatgccgacaatggtaaggacgatactttcgcggctgatatacatcgtcacctcacgatcaaagaacccaagcactttgatggtggagagttcgcgaatacgctcggaaacgttgatgttgtttaggttatagaggacgacgaaggataaaaccgcactaagcaaaataaagatcaggacaatcgggtctaacatgccactcatgttgtgcaaggtctttttcgcggtggtggtgaagctgatgcccacaattgcatgatgattcagcagacgtttagctaagcgatcgtcctgctgctgactttgcgggcgcaggcgaacgagcagcgagtttggtgccgactgtttgccgactagttgttgatacgccgtggcagagagatagccaaaatgaccgacatagtttttggcgatccctttgacggtaaaacgatgggcttgaccagccgtcgtcatcacctttaaccgatcaccggtgctaagcttcaatgcttttgccggtttactggtaatgataatgccggtacttggcagggttaaggcttggttggtagacgttgaacgcagactgacgtaaggttcaagctgtttgccgcttgtcggagcaaaaagattaacatcgctaatttggtgaccgttgctgcttaatttggcggtggtactgctaacactggcggcactacgataagcacgacttttttgcagaatcgatttggcagcggttggttgcttaccatctgccagtcggacgatggcttggtaatgaatcacgtcgccatattgtaaagtgccggtcgcggtaatggaatcctttatgccaaatccggtaagaatcaaggcggttccgccggcgatcccgagaatggtcatgacgaggcgtgacttatagcggaaaagattgcggtaactgactttttgattgaatgaaaggcgtgaccataaaggggtgatgcgttcaagcaggatccgtttggcggacttgggcgcacgcggacgcatcaaagcggcgggtttttccgtcagttcattgcgcaccacgatgatcgcagcgccaagagttgcgattaaggctaatagcagcgacaaaaagatcagtggccattgcagcgaaatcacttgcttaagcgggatgtagttcttatacaggcttaagacgatgcgcgggatgctgaagttgccggcaaagacgccgatgataccaccgagtaaaccggctaaggcagcataggccagatagttacgggcaatggcccatttgccatagcctaatgctttaaaagttccgatttgagcgcgggcttcttcgaccatgcgacttacggtggtaaacgtgattaatgccgcaacgaggaagaagaacacgggaaacacattggcgatggcagcgatacgatcggctgaaccgccataatccccgaagcccggtaaatcatcgcgggtttgccatgtgagactagtggccagttggtggcgggccgttgcggttgcttgctttttgaaccctgcttggtaagttttgactgtttccgccgctgttgccgctgctgcggtggcaggcatcccagctgcaactgcttgattagtggtcttggttattgccgcttgggtcattttagcttggatggtcttggctaaatctgcttgcgcctgcgctttaacgcgttgcttgacctgtttcattttcgcagttacggcgtcttgataggctgtgctgaaagtgtcgcgggtttgcaagtttggaaagcggatgttgagctgcgaggcaacaggcaggttcatttgctgatcggggatatacgcaaaataacggaccgtgccatccccgatatttgccgacccgcggctagtgtcttcgatataggccggtgagtcagcaaaaccagtgatggtatacgttcggtccttaagcccgctgctacgtgcaaacgtgtaatgctggccgagtcgatagccgctctttttagcaacggtgtctagcacgatttcattacggtgcgtggggaggcggccactggtgaggtggaggcgattgattgtggccgttttttgatagccgtataaagcgacaacatcacttgagcggccaccgattgcatatttgaatttaaccgcttcggcttgggttcccttgactgactgtgccgctttgacttgggcagagctgacgccagtagttgccagcagttgggcatcggcgaggtgatcggctttgacggtcgtattcagcgagtctttaagggcgggacccgtggctttaacgccgacaaataaaagcacgccaagcataataatgatgacaatcgcaatgaagcggccgagtgaatcgcgaatgttacgccaaagatttttagttaatggtttcaaactgatcacctaccactcgatgtccgctaccggtgtcggtgccggctcgtcgtgaatgctgcgaacccgggcatcattgatctcaacaacccgatccgccattttggcaatcgcggcattatgggtgatgatcaagacggttttatggtctttgcggctggcatcttgcaacagctgcaagacctgttttccggttttgtaatccaatgcgccagtcggttcatcacataaaagcagtttcggattctttgccaaggctcgggcaatggccacccgttgctgctcgccaccggaaagctgcgaaggaaaattatccagccgggcgcctaagccgacttgtttaagaaccgtggtgggatccaatgcatcagcgacaattgagccagccagttcaacattttccttagtcgtcaggttaggaatcagattataaaactggaaaacaaaaccgacattgtgccgtcgaaaagctgtcaattggcgatccgaaaaagttgcgatatccgtcccgtcaatccagacttcaccttctgttggagaatccatcccgcctagaatattcagcaatgtcgatttaccggcaccgctgggaccaagaatgaccgtgagcttaccttgatcagccgaaaaattaatatcgtggttggcggtgatgacggtttcgcccatttggtaacgttttgattcatgttttacttcgatatatgccattgtgacctcctgaagggtgttgagatagttcgcgcttgagtcaagcctgcgctcaacacgttgttcatttaataacattatgttagattaaaaccagtcgttcaagcacagaatccggatatctgttgttaaatgaacacgttgtacagatcatgttggtttggaggttatgatgacaggtataagcaataatcggcgagtacaatatactgtgagccagtttaaagcggcgttgttgcaaattctggcgacaaaatcgctggatgaggtgacggtcactgagatttgtcggcaagcggatctgaatcgaggtaccttttatttgcactttgcgtcaccgctggcattatttgaacaaattgaaaccgatttattaaatgaaattcaaccgtatctcagtgttaaaatagatgacatgaccaagatgctagttccgattctcaaggtcatcacacagcatccgcaagcggccacgattattctgaccaacccggatagtacggtgttggagaaaattgtccgcccgattcagacgcagacgcaagcacgctatcaggcatggtaccgtgaagccgatccaaaacagctcgcttattactacgcatttttcgtgcaaggggcggagggcgtgttaacgatgtggttgaaacaagggatgaaagaatcaccggaacaaattgcgaaggtgatcgaaaatgtggtgacaaaaggagcgccgcattgagcgagagccgtcaagcgctagttaattcattaattaggagaaagaaatgcaaaatgtaaaattaatcgccagtgacatggaccagacattgttgaccagtgaagggacactaccaccgcactttgatcgttatcttcggcgcctcaatcaagccgggatcgaattcgtggctgccagtggtcggccgctatacaccttgcaggaaacttttccgcattttactaagcagatttcattggtttgcgataatggtggattggtcgcctcgcatggtcagatcatcggcaagagtttaattccagccgcagcgtatcgcgagattgtggcgtttatctgtgacaagaccgatggcgttcccgtcttatgtgccttggatgctgcctatattaatgcggcagatggccagtatgccccggcgctattgccgttttatcatcaactaaaaaaagtgcctgatctgatggcggcttccttggaagtggacaaagtgacgatttacttccctaatgccgatagtcgtgccaatgcggaacggtatttccggccggcttttggccaaaactacacggttcaagtgagcggcgaaacatggttggatattcagaatctgggggtgaataagggtcgcggcatgcgcattttaagccgccattttgatattccaaccgcacaaatgatggcatttggcgattatgataatgacattccgatgttagagacggtcggttacagttacatcatggcgaatgcgactcaagggatggcgcagcacgcgaagtatcggacgcgcagtaacgatgagttcggggtcttgcatgtgatggatcaagtgttgcaggcgcaggaaggctagtaacaaatatggcggagattttgattcgtgtggtgatcgggttttatggttttttgatgctgctcacaatctggcaagcgggaaaaacgaaccagaacgcctcgtacttaaatcagctattcgcactggccgctacgctagtcctgacagcggctgttattcctgacaaattcagtgctttggtcatacttttgatcgggttattaggtctatcagcggtatcgtggtttaatggcatccgattgtatggcaagccgcatatgaagcatcatctgattaggttagtcgttcacttaatcttatttggattagcaatgtggttgctgtgagcgtgatggctttttgtgcaaccaaggtcaatgcaggtataaaaatacagggagtatgatgtgttctcacaatacttccctgcaaaatcgtgattacaagctacacgccgccagtactcgctaaagttcatgcggcgtttttgcttgcccggatgaacgataggactagggagactacgaaaaatcaaagataagcctgcgcaaataattttgctgccagcaggaaggccagtgctgcaataatgacgcgtaataattgaaccggtaagcggcgggcgatgatcgggccgatgtagccgccgatgaagagtccgatgccaagcggaatgaccattaaccactcgattttagtggtgaaagcataaatgacggtggcaatggcgttagctgcaaatccggtcagattcttcattgagttggagacaataaacggctggtcaactgtcagggttaaagttgccagcatgacgacaccggcagcagcgccgaaataccctgcgtaagcaccggttacgaaaataacaatggtctgtgcagcttcttggcgaaaggttaaggttttcaccggctcgcctggacgatgctcctgggtcggcagtttaccactgaataagagtaaaagtcccgcagcgatgatgaaaaacggcacaatcttttcaaatgtcgaagccggtgcaatcaatagaagagcactaccgaaaatactaccgagtgacacaatcagaatcagacgccaaagaaatttaccgcggccgcgcagttccggcagtgaggagacggctgaaccaaccccagtgaagacgagtgccgctgtattggtgacgttagcaatgactggtggcacgccgattgcgagcagggctggatacgagaccagtgaagctaaccctgctaacgtagcagtgaggccggcaccgatcccggcaaccagtaaaaaggcaaagatcgaaaaagtcatagttgctgctccttcaggaatttgtatgaatgtcagccaacatagtgcgcaacaccatgtatcaggattgcataggtacttataagctggcaaacattgctagtctcatcatacgctaaagcacgactatttgggggtatgataaaaggtaaagaagggacagatgcacatgtttgaaaatagcaaaagccggcttgatgccatttcggatggcgtattcgcggttgtgctgacattgatggtattagatattaaagtgcccaaaacgctgaccaaagtggacctttacgcaaccgggttttctgtcgtcatttactttatcagttttgcggtggtcggtcagtactggatctttcaccaagaacttttgcacactgttcagcagccaagcaccaattttttggtattgaattttttctatcttgtgttcatctgtttagtgccgtttgcaaccagttttatcagtgaccatccaggtagccgtattagtgcgacattatttgcagttattatctttatggttgatctgtttcaatttattttgttccgattagtcattggcgagcgaccgaaaaaagaaaatttaaatgctcatgattgggaggaatatcgcgctgcgtcactaatggtacttgttgccgttatttatattcttgtaggtttactgttgcccaagtggattcttgttgtgattgcgctcggtttaggcgcccgaacgttgaataataccattggacatcgacttcaacatcaaggcaagactcaataaaacgacgcctttataaccatatatttttaccaaactaaagatcgccccaaaccatctgatgagggttttgctaggatcatcaaatggccgattttttacgttgcgtaagtctgtgatacgatgaggcagaaacgaggtaactacgaatgcatggcacaaaaggattactgacattaaaattggttcaggcacaaatgactaacgtaaatgcagtccaacattgacacctataaaggagcgatttcatgacgattcaagataagatgcatcaaggggcgttgtatcaaccgatgaatgcagatctgcaaaaagaacagctggcggcaattgatcagctggcgatttacaaccagattccggcgagccatcaagcagaacgatttgcccaactcaaaaaaatgttcgctgaaattggcgctaaaagttatattgaggcaccgtttcattcaaactttggtggggcgcatgttcattttggcagtggtatctatgctaattttaatctgaccttggtggatgacacccatatttacgtgggcgatcgcaccatgttcgggccaaacgtgacattggtaactgcgactcatccgattgatccaagtctgcgcgaacaaggctatcaatataataagccgattcatgtgggccgcaattgttggtttggcgccaatgtcacggtgatgcccggggttaccattggcgataatactgtcatcggcgctggcagcttggtcactaaggatattccggccaatgttgttgcattcggttcaccttgtcatgtggttcgaaacattacggaagaagaccgaaaaacttacgatcacggtaagccaattgacctgtagcgaggcttagtcagcccaggttacttccgcaaagctcaaaataaaagttttgacggcataacgattcagccgagcagtcgtctgcttaagttccgcctgcgaaacaggggagggcttgacgtaataaaccgttccttcatcgtcatgactatatgcaggggcataagcattttcagaagaacgctgaatgcgggcgcaaaacgcactctgaaaataaccgttcattagcagctttgtcctgacagccattgtcgggattagatggccaatgacgaaaagcccgatgatggtataaataattgtcgcaagtttctgattaagtgtcatcttttttaatttggtcataggttgtcctcgctagcatgattttagcggcttgatcgaataggaaaaccggttgtgaaagcaacaaacgatgatataggtatgtagtggtcgactaataagtgtcaagagaggcacatgtttaaaatagcgccaactcgaactggcatcaaggcgaagttttttggtctaaaaattttaacgcaaaatgagcatagattgggaaaaatcactcgtccagtcccagcactcggccctaccagtgctatgataaaagcaactgaaaggaagcgtgtctatgaatcagtttgtgaaccatttgagttgtacagcattgcttgttggtaagaaggcgtcggttgatggctcgacgatgattgcccgcaatgaggatgcggcaggcgggattaatccgaagcggtttatcgttgtgaagccggatgaacagccgcagcggtatgtgtcaacgtttaacggttttcagttggacttgccgcagaccccgctgcagtatacctgtaccccagttgccgacacgagcgatggtacttggggtgaggccgggattaacagcgaaaatgttgccatgagcgctacggaaaccgagttcacaaacaccacgatgctggggctggatccacttgagccagatggtatcggtgaagaggctatgctgacggtggtattaccgtatatccataatgcccgagaaggggtgcagcggcttggcgaattagtgacgaagtatggcacctgtgaaagtaacggcattgccttttccgatgctgatgaagtctggtattttgaaacggttggcggccatcactgggtggctgagcggattcctgatgatcgttatgtattggcgccgaatcaaacggggattcaggagattgattttgacgcaccggatgatttccagtacagtgccgacttgaaggcttttgctgaaaagtatcatttgaataaagcgaagaaaggctttaatttccgcgatattttcggtgaagatacgcaggcggatcatttttataataccccccgtgtctggtatgcccagaagatgctgaatcctgaagttgaccaggatccggaaagtcggaccatgccatttagtcgggttccgagtcatttgctatcggttgaagatgtggcgatggttttaagcagccattatcaagcaaccgagtttgatccgtatgggcagacagggacggccgaaacgcggcatcgttatcggccaatcgggatgaatcgtaaccaggaaatgcatattttgcagattcggccgaacatgcctaaagcccatgcggcgattcattggctggcagaaggcgtcaacattttcaatagtccggtgccgttttttgccaactgcaccacgacgcccgagaatttccagtacaccccgactgataaaagttcgactgacagcttctattggctgaataagttgattgctatggtggcggatccgctgtttgccgaacataactgggatgccgaagtggcggtttcggaaagtcgcaagttcggatttgcggccggtcgcgcggcagtggccaaaggagacgcagggtttgcagacgtcaagcctgaagatctgccagcgtggcatgacgaattgaatgccgaaactgcagccacgatcaccaacgacctccaatatttgctgcatcaactggtttgcatccgcgcagaaaagatgacgccgacttttgaaaaaggcggcgaactatagcgctaatctgacacactttgaaaaaattgaatgcccggtcacactgacggattttcatcagtgcggccgggcgtttataatggtcaagaaatctatcaagagaatggaaagaaggtcttctcattaagaatacaaaaacagaacgctggatcgggttgattgtcggcttgatattaaacgcagcgggtaatggactttgtatcgttggggcgatgggaagtggtttgtggaccgccgcggcgattaatctcaatgactggcagggatggaatatcggtgcggttttgtttacattcggcgtgctcaatgccatctccaacttaattttgattcgacagtgggactggccacgattcatcggtgaggttatttatacgctgttcttcagttactttgtcaatgtttttacgtggctatttacttggctgggtctgggaaattggcctgtcatcgcccgaatctttgtttcctgctttggcgttttctgcttttgtgttgcgatttcgctgtatcaacgcgcgaatatcatcatgcatcccaatgacgacacaaccaatattttgcgcttcctgtactttaagggtaatgccacagcgtcacagttaaccgatttcattccaccgattattgtcaccgcgattgcttgggcggcgactggcaaactgttagggattaatattgccacattattctcgtttcttggcaatggtgtcatgattgcgtgggctgacgagcatatttggccgcaactgcaacataactttaaggttaaagctactcgatagaaatgacgagatgtggcgacgagggttaacttaatccaaatagcttttatggattagtcaactctaaagatttgtatcagaagatttgattttaagcaaaaatggttctaaattggcatagaattttgagtacagagggagttacacagtttttggcacttattgttgctgatttacaatcacgtgattaagcacggcaacatcacaacagtttttctctgagtttgtttttgttacaactctaattttacgttcacaccaagaagtttcgggatttaaagtaagattatatagtttgcttaatttaatgtaactgatcttgctttgtttaaacacgggagatctccacaacgattggtgtaattggaggctggatgaggtctactgcattatacgctgagtgacacagcttgcaatgatttagggagaaaatatggattacatttatatcgtgccacacgtacttgtgatgttagttttttctatcacgttaagaattaagaatgaaatgtttaaaaaagagcgaatagaacgaatagcgacatttaaacggattgactctgacgggggtgtcggcatggagaaagacggtgatgagagtttgaacacgctcgttggtcgaaatttgtatattgaaagaatgatgaattctcaaatgattgggagctatttggccgtcattttcttttctgcaggggttatctatgggaacacatctacagggcttcttcttttaccaagtatcggggtcttcctcctctttgctaatgtgatttttctgggtgaagaacaagttttccgcgtcatcaagcagagaaaattggaaagactctcggaaaggtacccaagcttaatgcgtgttcgaaaggttgggtcaaaatggtattatcgctaccttttactgcttgtcgtagttgggggactcaacttcgctatattttatgctgctgccgttgtcttctactaaagcgttgaatcagtcgcttctcggaatttgatgcctattggaacccgaatgctgttgtggaacaagtaagtaaaacagttccgagtcgtgccaatctcgggccggatggagtgagagtgcggaactagagcggtgctggcaaaaaccgagtcgctgtgttgtttcgtcggatgagcctatttggtcgctatatcagtctcaacggacacttatcttgacctgtatcgacttacataagcaatgcttgatacggaattgtatacttcatcttggaatattcgtcagagagagtctatagtgatgagatcgggagtgactaaggtatcactgaatctgagacggttctagtcagaacaacgtaattttgtcacagtaaaaaaggctttcagattttcctaccaagatacttaaatgtgttttatctgagtgattctgaattttttagccgagggcagaaaatgtttaaggaaaggaatatcaaaaatgaatgtctatataccctttattgagatggtttgtatctgggtgggcgcttctacaattatttcaattctcagaggaaaacagaaaaacaagttactccaagaaggcaaatatacaaatgaaagttactcagaagctagaaagaagatgcaggagcttaccacaaaggcgtcaaatcagctttttaatcgtgcttataacatcattattgtttggtattttttcatcgttgtgttttcgttgggagcaataacggcgaatttttcaattgcgccggttatttacttaattgatgcgatcttcctttttgcttttgcagttattaatcttggtgcatcatattatactcaaaaagtgaggagaaaaataaatactgagctaccagaaattaagtgtgcggtgaagatactactttttatttttcgggattttggcacggcgttagtatttttggtttcttatttgcaggcttaagctgactatataagtgttgcatagcgttcatttggaatgtttttgtcagcgttttttacatgaatgatattggtttgctacatgaagaggacaggtcataattctatctaaaattttgacgttgattaaaacgcgaaaactggggtggaataaactattaaaaatagttccaaacctcgcaaaactgcacatgtaatttcaatgcgctgtcacagcgttccagccccagctggccagagattgcgagggttggcacggcctagaacgcttttgtcgaccgatttttcaataattcggcgtttcagagggtacactgcacggtcaaaaattgtggtgcggcctcaaaaaaaaaggcacgccagctctcgtcggtgtgccttcctttttaaaccttgacctagtcagtcaactgaaacatcttaggaatcgaaagagaacctcacataaagaatatttccgacttaactgcatctgtatatttatttacctgttaatcgtctatttggtctttttcccctttaatgccgcgcaggaacgttcctacagccccgcggtctacgcctctagatatacttggtgagtaatagataacctcatcgttaagacgttggaagaacaagccttttcgtccatacaagttataaaaatagacagttcttggaaatgtgctttttgaccagatcaaatggtaggtcttgccttctaaatgaactatcgtatcatgctcattccaaaactggataacgttagtctgtccaaacgtagaaagtgatgtttgatggacactcatattaaacaaaaacaggctaacatagatacaaatataggttaaaataacttgtagtcgaggtcgctttacctgtttagaatttagacggatttcccacagagtcagagctaaaaagagactaaacatacttagacctaagatagtctgaaacatcgtccaatttgcaaaggcaagtgacaggaaaaaaagcacaagaactatcgacattgcatataagtgtctccagtaaaccatcaaaatcgcttcctctagcaagtttcgtgttcagtctcacaatttattttcattaatgttccaagtgaccctggatcatatttttaaatacgcttgctgccatcgttgcttgatcaggcgaatacgagacttcgaatttatccttgaaagcattcaatgcattgccaaactcagccgtctgagccaactctccatcgggatttaaaactcgaagtgcatctgactcaattttatcatgattgccggagaaccggtttgatacatattgattaaagcgttctgtattccccttgttgttgtaatatctgtcaataatcgaatacagggaggcattcccattttttaagctggcatagatattgactgcatccgcatcagctaacaagtcgcctactccaaatgagctttttccctttgatgcatctttgccaatatgatcttccattgcaacaagtaagttggcatatttatcagccgacttaattgaatccgaaatcccggtcaataaatctcctgcccatccagcaagatcttgtgtcccagttgctgaaacggcagcattaaaattcaataagctagctaatgctgcaatcatatgaatgaagtcggtcttaattcctgtcgcagtatcggtcaattctggaaaatcatcgtcgcttgtaatattccattttttgttttcattgtatatccatgtgtcattcagtgccccagtcataattgtccatggtaagcttgcatacctaaactgccgatacaattggcaaattaaacgtgctgccatcagtgaatctggcacagtgttaccatttttatccatattcttgacaaatgaatcggcgtcatcttgtacctttttcaggtagttaaagaactctgtatttacctctttcacagatgaactaacatgcgaaactccttgatctttgcccgggcttgcatcttggtcaatgctaatgccatatattgggtattctacgaactgatcgaatgcccaattacttggcatcttaaatcctaggttaccgctccagccatattctgagcacttgttttttgcgatttcataaagagtgctttgacggcgatcctcaaaaaaaccgaaccaacaaggtggcgtcggttcggttttccatcagtcgcgcttaacgacaagcttaattgagaggtggttcttatggtaaaggactataaagtggtcttttaaaagataaattgaggtaaataataaggtgtgacagaactaggtatgccattggttaccgcaagaattgtaaagccgtatacaatcagcataaacatgatgagcataaacaagtagctttctctttgtcgttgcaagatgcttgatggcgtccagagtaagtcatctttgttattaccttgactaatcaacgttaagaattggttatattgataccaccagattattgctgctagagtcccagcgacacttgcgcaaattaacattgaatttctgacactgtctgattgactcaggaaccaaagatgagtcaggttgacgggaacaagtttgaaaaataggccaaattggatacccagagcacaggcaataagcagagtagttgttatcaacaatacagtcgaaatggttcttaacgttttgagtaaacgatgttgcatatagactgttttgaagtaagaactgcgtgagcggtcgatctgtttttttgacatgtgcggatgtttttcttgttgaagggaaataactctttcgtttccaaccttgatgattcgtattggcattagaaaaacagtgataagaaagagcaagataatgagcaaaataaattcccctttttaattgaattcaggctaatccaagagccgctaatactgcttcgctaccacctgatgctccggctgccgctcctagtccacctgtaatccagagtaaaagtccaaaagcaagtactgtcagcgcaccctttccaagggtatttaatatttttccccagtcaatataattagttgttggccaatcatacgtttcaggattaagctctagttttatagtcaaggagagctggtctgtaagtgttttgccgtttagttctgagatgttaaaaataactgataacgaaatagctccatttgtcgctatctcagtctcaaccgacattttacctgagtcgatttgcgtaagcaatgtttggtgtgaaattgcatctgaaagaaaatgagtgacttggttatttacaccaatgttactaagagatgatatatagtttgtccagtcaatattgtccaatttgtgattttgaatttttatgattgaataatcatccggggtatggaattcttgatctaactcaatgctgattaaaagacctttgacatcaaggatagttaaaggaacattgaaatcccaactaaccagcccaagaaaacccattaaatagttcttagcccactcaatagattttgaattgccaggatcttttgaagtgtgagatacacctttgtctttgccggacgatgaaatttggtcaatatctgtgccgtaaatagaatattctgtaaattgatcaaacgcccaatttgttggcatcttgaatcctaagttgccactccatccataggacatatttgctacgaagctataccgaattccaatcttctcggcgtgcagacaaacatttcgcgttccataaacacctgtattgtaaattgattggctaagaatgttttgaatggctttaatgtaaggaataaccgtcccgtcaatatcgccttcttggaaatcaacatctacggcgaaatagatgacagttccagctggtagttctaggtttagagcagtcttgatagccgtttgagcatctttctggccttgactcgcagtgaagtaagtttcaacgtatccaccgtcttcgtaaattggaaagaacttcataccgccatcaagaatcgttttgatttctgttggggttaggttctttggtttaaagtcagtaccgactgtgcctgttagataacgaccgacaatgctaaaaccgtagtctcgaaaatgtttaacatcttctgcggtcaattgcgttgctgtgtctaatgcgatggaatcacgaccggtatcaccattgctggtaactaggcccttaataacagtgtagtcagcgatgccggaagtttcgttagggtatttcataaacttccggaagcgaatgatgctggtggcgacgtcgcttccaaagctttcactgaagtcaccgctgtacatgctatttaaatacaaaccatatttgacgatcttgactaacaggccggttgatccgactgatagctggacgttctttaatgcagcattggtggcatcaccgaaattaccgtttgcaacatcagcggagatactcacggctcgctgtaaggcgtaaatcaaaccaacatttggctgactaaaattgaaataattgaaagatccgctacaactttgcatattagatttcggttgcaacccgcttagtaaatagtacactaacattaatatactaaaagcggagggaacaggatgaatgatgagctgacgattcgaagcgggattcgcgatgtgatgccgacagtgtttgggtacattactgtcggaatggcttatggcattgtggcgaaaaccgggcatttgtcgctgctgatgatcgggttgatgtcgctaatcgtatatgccggatcagctcaatttgtgttggtgagtatgttagcaaccggcagtccgattggggccatggtgatttcaacggccttgattaatgcgcggatgagcctgatgtcgatgacggtcgctccttatttaaaagatgaatcgatgactcagaatgtgctgatcggtaccttgctgacggacgaaagctttgcgttgtcgatgaacaagcttaattacaccggccatcatttaaatgctccctggtttcataccgtcaatgttggcgcgtacttagtctggtttattgccagtcttttaggggcggtgattggtggcttgattcctaatcctgataattttgggttggatttcgcagttgttgcgatgttcatcggtttgctgtacttgcagatgattacggatcgatcgaagccttttttgcggcatttaagtgtggccagtgtcgttgccgtcgcgatggtggtgctggtgcgttacttgccggggacaacggcgattattgtcgcaactgtgattggctgtctgtttggaatgggggtggaacggcatgcagaatcctgaaacatttgtggcgattttgagttgcgggctggcgacatggttattgcgggtggtgccgattgtcttggtaaaacgcatgacgattcctaaatggctgctgcattttctcagctttgtaccggtggcgattttatcggcaatttttgttgaaagtctcctagtgattcaccccggacaatggccaggcgtcaactggtcgaatttactagcatcgctgcctgctattgtcgtggcgattataaccaaaagtctctttgctgtcgtggtcgcgggcgttgctgcgatggcgattttacggctgctagggtgggcttagccattatggtcatcttttaaaaaaggtggctttttttattttcttgatagcagcaaaactttgatttaacgggcatcaggaaagctttcttttagtaaaaataatagcttcatattgggttaactcatatatcagaatttctagtgccaaataaaatagccattgaaaagttttactaaaataagtacactacaaggtgtaagcgatttcagaaaacgtactctttaaaacttgaaatggaggctttttgcatggagacatcgttgttatacccagtgaccaatgatcagcgcacggatcagaaactggatggactttggcaatttaagtttgatgaagctggagaaggtgaaaagtccggctgggagaccggttttcacgatggcgtttcgatgccggttccggctagtttcaatgacttctttacggataaagcaagtcgtgaatataccggtgatttctggtacagtcgcaacttttttgtcccttctgcggctaagggaaaggcattgtttctgcggtttgatgcggtaactcaccgggccacgatttttgttaatggcaaagagattcgaacgcatgaaggcggctttttaccatttgctgccgatatcagcgaggccgttaagtatggtgccgaaaataccgtggttgtcaaaggtaataacgaattgtcgcgggaagcattgccggccggggatacgattacactgcggaatggtaagaaaatggtacgtccgttctttgacttctataattactctggcttaaatcgctcggttcacttgttgtccttgcctcaagagcgggtgttggattacaccactacttttgcgttagctggcaacgatgcaacagtgaactatacggttgaaaccaatggcgatgcgccggtaacggttagtctggcagacgcggatggccaggtggttgcgactgctcaaggcaaacaaggcgccttacaggttcaaaacgctcacctatggcaggttcgcaatgcctatctttatacgctgacgattcagcttggcgatgatacccagacaccgcttgatacttacaccgatcggatcggtattcgcacgatcaagatttccggaaccgatattttggtcaacgacaagccgatttatctgaaaggctttggtcggcatgaagattcaccatttgctggccgcgcgtttgacttaaatgttgaaaagaaagactttgccttgatgaaatggattggcgcaaactctttccggacatcgcattatccatatgacgaacaggtttacaagatcgcggatgaagaaggcttcctgctgaccgatgaagtaccggcagtcggctttaaaatggccgccgctgcttttcttggcgggctgaaccagtccttcttcaaagggccatggctcaagaagctgcatgaacgccatattgaccagattcgtgatttgatcaaacgcgataagaaccatccgtctgttctggcatggagtctgtttaacgaaccggatacaattgatgaaaatgcggtcccatactttaaacagatttttgacgaatctaaagatcttgaccctcaaggccgcccgcggacgtttactttgagcgaagatgatacgatcgagacgtcaaaagtactcgacttcccagacttttacatgctcaaccgatatcctggctggtatcattttggcggctatcagatttccgatggcgaggctggcttgcgcgatgaaatggataagtggcaaaaagcaggcgttaagaagccagttgtctttaccgagttcggggccgacaccgaagctggcttgcataagttgccaagtgtcatgtggaccgaagaatatcaagtcgaagtgctgaaaatgttcagccgtgtcttcgatgattatgacttcatcaaaggcgaacaggtttggaatctggctgacttccagacggttgaaggtaacatgcgggtcaacggtaacaagaaaggtatcttcacccgcgatcgccaacccaaagccgcggcgttcttctatcatgatcgctggaataagctgccgctggattataaagcaaagtaagttttgggtgaaagtatcagcagtaacgaaattctaataataacgtcgtcggtgtagacgcagaataccaatcttggctgtccgtaacgggcggtaagattggtatttttgcgtgcgcgtgaatgtctaaaggatggcctgacttaatccccccaaatatcagcaactattttaatcgacagaagattgacaaaccctgcttaaataggccgtaatggcaaacaattggcctaaaccattgaaaaacatgcgacaaatttggcaaaaattattgttgttaacccttaaacatgtatactaatatatgagtttaacaagtaagcgcattcagtaagtgcttttatgcacggttactaaagggggtgccgcgttcaggcaaaaaaagcaatcggtaaacgcagacggaacaaagacatgggaggcaaatactcaaatgaaagcaaagctgattggctcaaaacctaaaagcagcagatacagattgctttggtccggtattgtcatggcaatgatggcggtatcactggtaatattgctgacaatacccgctgcaacccgcgctgcatcgcaaaacccggaagacacggttgccgttcatctcgatgggaacgacattgcttcaaacaacaccaacggcctgacttttaagggcttcggtgtcctgagtggtaacggtactagtgcgctgttaatggattataaatccgaacagcccgatgtttacgccaagatgatgaagaccttgtttggcggcagtcaacccattatgaccaatctcaaactggaaatgggtaatgaccgcaacaactccaccggttcggaaccggccacccaacgcacggaatcagaagctgccaatgtgacccgcgatcaagggttccagttagtggcagatgccaagaagattaatcccaatctgaaggtgacaattttacgctggaacgcgccgggatgggccaaaacaaacgatcagatttacacttggtacaagaactcgattttgaacgcgtatcgtacatatggctatatggtcgactatgttaatccgggattaaatgagcataagccggatctagcgtgggctaaagaatatgcagagcgcgttaaaaccgataacaccggctttaagaatgacacagaacgtcaactttataacaagatcaaagtggtcatttccgatgaggtcggtgttggtagttttggtaaggatatggtcaccgattcatccttacgaaacgcggttacggcagccggctatcactactcaaccgaagatgacagcgctaagaacttcacggcacttgctgataagtacgacaaggaagtgtggaatagtgaagctcaggccacttttggcaactccgactaccggcctaattcaggtaccggaatcggtgtagcaggcagctcattagaaatggccaacaccattgtgaaaggttttaccgattcacggcggacgaattttatctaccaaccggcaattgcagctttctatgaaggcggtcaatattcatctaagagtgtcctgcaggcaaccgatccatggtcagggtggacgaatagtgatgttgcgattgatgtgcttgcccaattcagtaaatttgccaaacttagttgggaaaatagcgacaatacgtctggtatctggcgcgccgtatctcaggcaagtgtttccacggcaacgggttccaataatgtcaacggccgcaacggtttggctaactatttaacccttgcttcaccggataaaaaggatttttccacggttatcgtcaatgatagtaagtacacgaagcactatcagatctcggcttccaacatggcttataaaggaaccccgacccttgaggaatgggaaacacgggcagctgacacgactgcaaaagatgcgtatgacagcaattacctcaaacatgttggtgatgtccaagctgatagcaaaggtgtttataccgttacggttaaaccattttcaatcaagacggtcaccacgcttgataaggcaaaggattccgatttgaaccaaggtatatcggcttcatcgaacaagcagcggacggtacttgataccgatgccaatggtaaagggaccgacacctcagacacgaccttgtatgcagataattttgaatatggcggtaagaaagttgcaacgctgaatgctgatggcaccagcaacaccgcaaagactgaagacttcataacatcgcgcggtggtgacgaaggcttctatccgttgtatacatttaatcgtaatgggacacttgaaggctacaagacgacaaatgccaagtcaggtcattacgttttacgccagcagttggactcaacggtggtcgaaccgggcggggcttggaacgatggcgatgcgttggcatggatcggcgacaatcgctggatgaattacaaagccagcacggatgtctcatttgaagataaaggcacccatggcagcgcaaattatgcttcgatcggtgcacgtcagcaggctgattcaggcccggcagcctacctgaaattctggcaggatggcggctggtcattgcatatcggcagtcagtcagttgcaagtggcaatgtcgccactggtcaaggcggcaccaagatttccggcttcgatacaacgaatacggcttggcacaatattgccattcaggcagcaggcaataccatcacggcttccattgatggccaaaaggttgctgatggcaaggtcacgtctgagctttccggacgagttactttaggcagcggctacttccacactgactttgataacctgaaagttgaaactgtcaaaggctataccccgtactactcgcaacaaatcgatgacttagagatgtacgacacatctgccacaccaaaacaacaactggtttataacgatcagtggacgcacgaaaccgaacaaggtatgtacttgcgggaccggacagtttccaagaatacaggcgccggtgctacccttacgtatacgttcactgggaccggtctggatatttgtggcaacaatgatggctcagtgaagttggatgtgacggttgatggcaaacaagtcgcaacagatgctgcaaccaacaaggccgacaatctcgggcagacctacacattacgaaatttgaagtacggccagcataccgtgacgttcactgtcaaaagcggtacgttagcagttgattatgtcggtgtcgtcccaagtgacaccattgccgatttcagcaagctgcaaacggcttacgataaagtcaaagatgtcacgaacgccgataacaagtacacgtcatcaagttggacatcgtttcaaaaagttttattagcagcaaaaaatgtccttgcagacacgacggtttcacaaaacgatattgatacggccctcaaaaacctcaacacagcatatgccgccttggcgcttagcccagacaagacaaaactacaaacggcttatgataaggcaaaagctgtgactaacccaagcgataagtacacggccgccagctgtaaagtattccagaccgcattaacggatgcgcagtacgttctcgctaacgccaacgcaactcaaaatgatgttgacagcgccttgaagaatctaaatcaggcagcctctgatttagtgctgaacccggccaaaccagataagacgaaacttcaggctgcttacgataagaataaggcggttacgaacccagacgacaagtacacaagtgaaagttggcaggcattccagacggcgttatcagatgcgcaaaaggttcttaccgacaccaacgcaacccaaaatgatgtcgacaacgccttgaaaagtctgaaccaggcagccactgacttaacgttgaacccagcaaagccagataagacgaaacttcaggctgcatacgataagaataaggcagttacgaatccaaacgacaagtacacgagtgatagttggcaggcattccagacggcgttatcagatgcgcaaaaggttctcgctaacaccaacgcgacccaagacagtcttgatacaaccttgcaaaaattgaataacgcttatgctggcttaaagcttaacagccagaaaccagataagtcggcactacagacggcttatgacaaagacagtacagtgaccaaccaagctaataagtacacgaccgcaagttggacaaccttccagtcagcacttgctaatgcgaaaaaagtgttggcagacactgacgcggttcaagcagatgttgatacggctttgcagaagttaaatgatgcttatgacggcttaacccttagcccagataaatcggcattgcaaacggcactcacagaggcacaaacgctcagtcattcagcagtaactggcgaccacgaaggtaactacccagcagatgcgcttaaaaccctccaggttgcgatcgacaccgccaagaaagtcgcggataaccctgatgcttcaaaagatgatatcgacactgcagcatcaacattaaaacaagcggtcacagcctttaaacagaccgttgtaaccgtcagccgcgaccaactgactcagctcgtcaccgagtcgcaaaccttgcgtgccgatgattacacccaagacagctggacgccttatcagcaagcagtagcagcagcacaaaaactgttagcaggtaagccgagtcagcaagaattagatgcagccgcaaccgcactgaagaaagccaaaaccagtcttgtcgcagcgccaacaggtaagctgccatcaacaggtgatgcttcatccgaaagtgccagttctagcgaagaaacagcttcttcatcaacagccaagtatccaagtacaggtgaagcacagctgtcactggccgttacgatggcagcagtcgttttcctcattggcatcagcggctttgcatggttcttacaccagaaagggaaagctaaataatcaagcacgtaaagcgaacgactagataagcttaagacccctgactatggaagatcaaaactaaataaagaggctctagggacgattgaagtgtccctagagtctctttttggctgatggtcaaaatatagagatgaaaaatactggaaaaagtgtcgcagccatctccaaggtaatgactacccaaaattgtcagcaaacgacgcttaacataccaagaatagtatttggagatataactaaaaaacacttgccgggagtgtccttcatggcaagtgtttttggtagttaacaaaagtagatcagtcgtttatggtgatagtattttctttacttaccagcccgaatggcatcaagcttagcccgatacttcttagctgtagcagtgacgccggcatagtcgccggttttggctgcggcggtgaggttgctgccggcaccgactaaggtaacgccggcatcgaaccaagtttcgaggttatcaagcgacacaccaccggttggcataatggccagctgcgggaatgggccgtgaagtgctttgaccatagccggaccagcaacactaccagggaagaccttcacgagatcgacgccggcttcaagcgcggtttggatttcggttggggtgaagcagcctggggtgtaaggaattgaataaaggttgcagatcttggcaacgtcagcattgaagcttgggctgacgatgaacttggcgccggcaatgatggccaaacgcgcggttgcaggatcaagaaccgttccggcaccgatcaggacgtcttcacggtcaccatacttttcactgagttcatccaatgccttgtcagcatgcgggacggtgaaagtaagctcaatacccgtaacgccgccagcaatcacggcatcaacggttttgaccgcttcatcagcatcgtcaccgcggacaacggcgacacagccggtgttaattaagcgattaagatagtcatatttttgcatgggtgttttttctccttagacgtgttctgtagtgaagaaaatcaaatgggatgcttaaaagaattgagtgtctcacgcgcgctcagttttattaagactggtttgcatgaacttgtcaagctgttgtcgcgttgggtaaccggtgttgtcgccaggtgattgaatcgctaaggcaccgatagcattaccgcggctggctgcttcggccggtgagcggccttccaggatggcgctgatcacacctaatgcaaagccatcgcctgcgcccaccgtatcgacaatgtgttcggccggaaaacttggcagtaactgtccaggcacatcacggcctaacagatacgcaccttgtttaccgactttgacaatgaccagctgcgtttgctcactttgattgagatagaagtgagcgatggtttccggatcatcactgccgacgagaatttttccttctgcggcacctggcagcacgatcgatgcacttttggccaacgaattaatcgttgtcaccatggtgttctgatcaggccatagtgctgggcgcaaattggggtcgaacgtgatcagaatgtgattgctgatcaaacgtttcatcagccgcttcgttgcagccagcgttgatgctgaagcggctgggaagataccggtaatgtgggcaagtttgacgccggccaagtcaatccgatcaatcgccgcgggatcaaaatgcgctgccgctgatcctgcccgcagatagtaggtgttaggatcgccatgcgtcacacgcgccttgaactcgatgccggttggataacgtgaagtcgtggttacattgtcgcaaccgatgccggctgctgtgagttgttggcgaatgaaaatgccattcgggtcttcaccgagatgcgtaatgtactcgacggaatggccgagtcgactcaatccaacggcaacatttaactcagcgccggccagatacttggtaaaatgtttggcggccgctaatggaacatctgcttcttcagcggcaaagacgactagcggttcaccgattgtcaggcattcattcacgtgtgatcgtactcctttaagcgtttaatcgttgttattgtcgtagaaaccaaagtagtcatgcgcgttcccatagctgatattcttgataatccggccaagggcatcaaggtcatatggtactcgaccctgttcaaccagttcaccatagaagttgcacagtacccgacggaagtattcatgccgcggataagacaggaaactacgcgaatctgttaacatgccgacaaagtttggtaacaggctttgttgcgcaaaagtctgaagctgccgatgcatcccttcagccgtatcattaaaccaccaggcagcacctaattgcaggtgttgtttatcgccttggccaacgaagctttgtaacatggtgatgagtggtagccaatcatttggattcagggaatagaagatcacttttggcagtgggccacgcgcgtccatcgcttggaaaagatcccgaaactcgccgaccaaatcaggttgactgcccatcgcatcgaagccggtgtcgggaccgatctttttcaagttcggtaagctgagactgcgatcaacattggcatggaactgcatcgtccagttgaactcccggttgagatccatcagcatttccacaagtccggtgagatactgatcattttcaacatcactgactggccggttttcaatgcctttcttgataatggtatcaagtgcttcttgatcgactgggcggtagtggaagctgttgaggccgtggtcagaaaggtggccaccatgctcggcaaagaaggtgaagcgttgtttcatggctttcttcaaggaagcaaagtcggtgatttcaacgcctgctgctttgccaagggtttgtaagtagtcgccgtaagtattggcacagatcgccattaacttatcagggcgcatcgttagcaatgagttcgtggtagtgcaagtcgctggctggatcatcggtggtgcagacaacttcgacatgactgcgccgaatcaacgcgcgcggcgtaaactcaggggtagccagtttggcgttggtgagatcccagacctttttggcggtgtcacgactcaataccagatcactgccgaagaaacggcgcagttcgaggtgggtccattcaaacacagggttgccccaagcattttccatggttttgcaccaggcgacaaacttctcgtaatcatcgccatcgccagtgatgagttcttcagggacaccattagcccgttccaggcgccacttgtagtgatcgccgtatgtgccttcgtttaaccaaatgcgggtgatgttcttgaagttacgattttcatagatttcctgcgggttaagatgacagtgaaaatcaataatcggcaggtcagcagcatattgatgaaatagttgcttagccggctcattggttaagagaaaatcatcgtccaaaaaagccattactttgcgctccctttttctaatgcttcccagaggccgtttagataggtgatgcctaaagcacgatcgtataaaccatagccagggcggccattttcgccccagatgttgcggccgtggtcaggacggatgtagccatcgtaatcaaggtcatgcaaggccttcatgatttcgtacatatccagcgaaccatccttggaaaggtgatcggattcgtggaagtcgccttctttgttgatgaacttgatgttacgggcgtggataaaaggtgcccgatcttttttgacaaattcacggatgatggctggtacatcgttgtttggattttcgcctaaggaaccggtgcagatggtaaacccattgtaccgagattcatgcatgccttcaatgatccgcatgtcttcagcgttcttgtaaacccgcggcaagccaaagagttcgcgcggcggatcatccgggtgcatggccatgcgaacgtcatacttttcacaggttgggatgatggcatcaaggaagtacttcatgttctcgcgtaacttagcggcatcaacgtcagcataagctttgaataagcgttcgatttcagccagacgttccggttcccagccaggaagaacatagccttctgagttgttacgaaccgaatcgataatatcgtgtggatcgtcttttagatattgatgttgaaaggccatgacattgctgccgtcttctagctgatagtggagattggtccgcagccagtcaaagatcggcatgaagttgtagcaaatgaccttgatcccatattcggaaaggttcttgatggtttccttgtagttttcgatatacttgtcgcgtgatggcaagccaatcttaatgtcatcgtgaatgttgacggattcgatgacttccagttttaagccggcatcttcaacttgtttcttcagtgcggcaattttttccttgggccaaacttcacctaccggaacatcgaaaagcgcaccgacaacttgttgcgtaccgggaatctgacgaatttgctgtaaggtgatggggtcatctttttcgccgaaccagcgaaaacccatttttaaatctgacataaattaaagctccttttcatgatcttgacgaaattgttcaagggtcttagtcactgcacctgggccggcaatgagtttcttgaagtcggcttctacttggtcagccaaaccgatttgataaaggtcgtggccaaagatctgggcattgctcaagattggcttgagtgcggcgtggacatcggcatcactacctaacttgatgtcggcaacatatggctgtaactgatccaataatgggtcgcggcttggggtgaagtcgttacctttatcatccaatgccatcaggtaacggcaccaaccggcaagaatgagcggaattgccttaagctgcttaacgctttcaggatccttgtccaagtagtgctggatcgtcacgccataacgaattggcaatttctgggacgtgtcgctggcaatccgttgcggggtatcgggaatattcttgtttggcaagcgcttggtgaccagctgatccagaaacttcttaggatcgataatcttaggatccttcacaactggcagatcttctttatagccaaggtacttgatcaaagtgagcaaattaggattttcaacttcagcagcaattgacgtgtagccaaggaggttaccataaatggccaaagccgtgtgcaatggattcaagcaagcggtgaccttcatctgatcggcatcgttaacggtgtcgcgatcggtgaggatgacaccggcattttccagcgccggacgaccatttgggaagctgtcttcaatgacgaggtagtgggtttcttccgtattaccaaatggcgcaatattggtgtgcttaggtgtgtgcacgatggtggtgtcttcaaaaccttctgccttaagtttgtcggcaacgttttgcgccgggttcggtgtgatccgatcaatcatggaccatgggaagctgacttgcttaggatcggtcagataatcgatgaagccttgggtgaccgtcccgtgtttagcccagcccttggcaattgtcaaaatgccgtcttcataacgtttgccgttttcagagaagttgtcagtgctgaccatggcaattggcttggcaccggcttcgtaacgtgccaaaagtaggcgcgcaatggcccccatattggtcgtcgcatcatctggcttacctgcgatatcagcttcggcagctggtgtcagtttgccgttgatatcagtcagttgatagcctttttcggtaatggacatcgtaacgagttgcagtgaaggcttcgtgaagatttcttttaaatgttcccagccttcaggattggtcttgttgtagtaaatcgcttcggcaacactggctatcagtgtcttatcaagtgtgccgtctggttgcataaccacttgcaacacgcgatcgttatatggcttgtagatatcggcaggcacatcgccatcataagtttcggcaacaaccacaccagactttaagctgccattattgagcaagtcctgcgcaatcttggcatgaaagcagcggaaaagattgccgccgccgaagtgaacccatacaggattggcctcagttgtctgtttcatttgttcttggtcgaattgcggaacagcgataccagccgctttgaaatcagcagcctttgcttgataatcgtcggttagcttaaccaaaatgatgaacctccttatatattaatatatcagtttcacacacttaatatagcacgtgcgggttaaaatggaaagcgctatcagaatacttttaacattttaatccaaaaaatatttctgtataggctctgaaccattaaaaaggaaaaagtcgaatcaacaacagttatccgcgttgtttgattccgacttttccgacgttatttcttgttagcattcacacctttgctagaaaacctgtcatccacaatattagcagataggtgagcatacgctttctgttaattaacgaacacgtttgatggcggcaatcaagaagccaccgatgatttccattgcaaccgcgaagatgaagactgcctgataaccgaagccttcaacaatagcagaagcaaccatggcaccaagcatctggcccaacgtgtttgctaagttgatcagtcctaagtctttaccagcagtatcagaagatggcagcacatccatgttcaacgcgccatcgactgagttgtacaagccattaccaaaagcagcgataacagcgtaggcaaacattgcccaagcttctttgacaaacaatgggaacaaagcagctacggctaaggcgaacgttgcgataacaaccggacccttaacccgcttcattttatcggcaagtggaccgccaactaaagcgaagaagacaccaatgactaacatgatggttgaaaatacagagatggaaccgccagcttgtttggtgctttgaccaatatagtcggtgaagatgaacaaaaggaatgtggtaacaatcgtagaaccgacaaccatcaggaatttacctgacaaggcgagataaaagtcgcgcgcatcatgggttgggaagaagaagtacttcttgagtgattctttgtcgagcttgatctttggttcgtccaggttgctcttttcgttgatcaacagaacgtggataatggccaacacaacggtcatgcttgccatgacataaataccgaatttaacattgccaaggaattgagcggctaacagtgcaaaaccttgttgcgcgatcgtgaaaccaacgccgtaaaaggttgaaacagtgccacgccatttaggtgcaacccgatccgatatttgcggataaatcgctgcggcaatcgcgttttcggccgccgccgcgatgatccagatgaagatgatagcagtaattgaagtcgtattagcaatggcgaccagtgaaagcgcgattgctatggtaccaaggacaatataaggtttccgcttaccaaaacgggttcgcgtcacatcggaaaaagcaccaaacagtaagttggcaatcgcaccggtgatagacgcaacggttgccagaatgccgacagcccaaaccttgtgtgccgaatcaatttgactaaatagttgtggaattaaaacgcttcgggttgaaccgattggcccgtaccagcaaagtggcgcgaggaacattgcagttgcaacaccaagtggcatctttggctgctgtgaatcttgaatccttgcgttggtaacaaccccaaccgtcgttttgaccgctttaggatcgttcttaacatcatttgccatttttttcactcccatgaaattaagtaagtgcattaaaaaataaatagatagaacaaatgcataaatgccggaacctgaattttgacacacccgcctccttgccaatcagcttatgccacttaaaacctgattggtcacaaactgcaaccagttgtgaccttaatggtagatatacaaccagtcagctaatgttaaaggcgtattttttaaactaaacgcgcgaaaacattgacactcggataactgatatattagtatatccttacaagggcatgatagcgcttaccgaaaacggtgtcaacacctgtcaaaaagttttataatttatacgtctcaagcaacatctttctcgaaaggctggggatgttatacaatcagataatcaggtgaaaaagaaggaagggtgacgcccatgcaaatatcgaattatcaagatgaagcatacaacgctatcaaggagatgattctcagcatgcagctgacccccggggaaaaagtcgacaagactgaattgagcgcgcaactcaagatcggtgcgaccccgatccgggaggccattatccgcttacggcgggaaggactatttaatgtcattcctcaaagcggtacttatgtatcaaaaatcaatctggatgaaatgtatcaaggccggtttgcccgggtcaatttggagcggacgattgtggcggacgcagttgatgtcatgacgccagatcaaattgctaaattggaacagcaaattgcgttgcagggtgtttatgagcattctcgggattacgatcatttttttgatcttgatcacgactttcatgaaatattttatatggccgatcataagcagtttatctgggcttgggtacagcaaatgaatttgcaatttaatcgctaccgatacttacggttggaagttagcggcttaaaatggcataacattatcacggaacatcaggcaattgtcgatgcagtcaaggctaaagatgctgagttagccagtcatttggttgcggatcatttgttagcgattgacgacgatgttaaggcagttttaagtgcctatcctaactattttgaaggaaaagcagcgccaagccatcagcctgactaaggtgacgctgttgtcagattttgttcactgtaagcgcgatcgtgcccaacgaaaggaaggcttacagatgacaaaagtattaacattcggcgagatgatgttacggttgaagccgtatgatcatcaacgtattcttcaagcgtccggcttcgaggccaattatggtggctctgaagctaatgtggcggtttctttggcattgcttggcgacgaggcgcagtatgtcaccaagctgcctgataatgcattaggcgacactgcgcgcaacaccattcgtggtctgggcgtagatacacataagatcttgcgcggtggtccgcgtttagggatttatttctttgaaaaaggggccagtgtgcgcaacacgaatgtcgtatacgatcgtgccggcagttcgtttgcgaccgctgaagctgatgaatttgattgggccagtctgcttaaagacgtggcctatttttatttttccggaattaccccggcgatcggcaaacatatgcagaccgccattgaatcagccgttaaatactgtgccgcacatgatattaccgttgtttgcgacatgaattatcgcggtaaaatgtggtcgcctgcagaagctcaggcattctttgccaaggtcatgccttatatcacgattgttttggctaatgatgaagattttgaagcaaccttaggcattaaggcatttgatggtaacatggcgaccgggattgatcagatcgccagtttcaaggctggtatgttgcaggtaatgaagcagtggccgaatgttaaaaccgtggccagtgttgtgcggaacattcactcggtggaagatagctggtggacagggcttttggccgaagatggcaaaacataccaagggccaaccttccacatgcatgtgatggaaggcgtggcgtcaggcgatgcgtttggggcaggtttgatgcacgcgacgctccatgactcgcaggccaagatcaattatgcgatttcagccagtgtgttgaagttgacgatcagcggtgatctgaatttgattacggatgcagacgtgcaggcggtcatggcaaccggcagcggtgttgatcgttagtcgggcaagaagaaagtgaggatgcaataacatgcatacgttgacgattgatggtagtcagttgcagttagagcaaaacgaagccaacacaattaaaggatttggacttctaagctgtaacaatacatcaaggttattaatggactacaagtgggaacaacccgaagtctatcagcaagtgctgcaacatttgtttggcgggcaacagcctttgatgcgcatgctaaaagtagaacttggcagcgattcgaatacatcatgcggcaccgaaccggctcctcagcgtgctgcggacgaaccggctaatgtggcacggggcatggggtttcagctcattgccgatgccaaaaagattcagccggacttgaaaacctgcatgttgcgctgggcagagcctggatttttacggccaagttggcgccaggtgaagtccgatgatcctgatgaaaaggtgccgacagaagcttttgaagccatgtatcagtattacaagcaaacggtgattgcggcttggcaggcatatggttatctttttgattacattgatcccgaccgtaacgagaccaaacacccgatgtatcgctacttaaaatggtttgctaaccggctgaaaaccgatcaggctgatttccctgaaggttttccagtagcagattatcatgcgattaagttgataacgtcagatcaaaattatggaaccgacatggggacagcattgcttaacgatcctgagttacaagcggtgattccggcagttggctaccattacaacaccgatgacggtccggacaaaccatttacgaagattgccgatcagctgcataaggaagtctggtacagtgagggtattgcgccagtcacattcggcacgcttaggacacaagatactactggcattggcataggcggtccaatgagtgctttggatgttgccaatcgtctggttaaaagttatgcccgctcgcgtcgaagtttatacatttttcaaccagcgattggcggcttatatcccggcgcaaaatatccgggaaagcaattacttgaaatggatacgccgtggtcgggttactttcagcaagatacggtggctttggcggtcatgcatcacttcaccgactttgccgtaacgggatggcgcgatcaaacagccgcaaaaaactggcggtatgttccgagtgccacggtaagtgaagtggcggggactgaaaatctgacgcaggcgtttggagctgccagtgtcatgacgttagttgccccggatgaaacggactacacggtgatgctaatcaacgacaccagtgctccccaaacctatcagattacggttaagaacctagctgctgcaactaaaccgctatacgtatggcagacttgggccgatgatgccggtaaaattcacgatcgcgaaaagacaaccacgctgacgccggttaatgggaatgtaacggtcacgattgaaccgcgagcgatcatcagtgcaaccaccacggatttccagccacaagccttattacctaatcctgatgttaagactgatcagccactgcaacaggatccggaaaatcacgttcttttccacgatgattacacctatgccgatatgccggctgattatctcacgcgccgtggcggcaccccgaaatatacaactgacatggatggcgcgtttgaagtcgttgagcaggacggtaaacgcgggttacaacaaaagattaccgagcagtcgcgggcattggcttgggaaacgcaaaccgatccgaactttaccgttggcgatattcgttggttaaactatgcggctgcgttgaagtttacgtttgacacgacaacccggcaaaatactgtcagtgccaactatattggccttggcgtgcggagtgtggacgattttgaaggcagtttattctcggcgccatatgtggctacgctgacagttggtgggaagttacgcttttacgttcgcggtgctttggcagccacacttgatgtgccggttttcgatgccgaagtgagtcacgaacttattgttgaagcaacagatcgccatgtgacggtgcaaatcgatggccagacttatgtaacttatgacgatccaagtgatcaaccgggtttggccgggcaagtcaaagtcggcaccggctatttcaagacggtgattcaggctttgacggtcacgagtacgtcagcaccagcggtattaggacatcgccgcgatgacttagatgccagcctaacgtttagtgacgatcaatgggaacgccttgccgcacgttttccgcatgcgtgggaacgctcgcagtcaattggcgaaaaaggcgctaccgttgactttgatgttgaaggaaccggttttgtgctctttgggacgcaagcacacgcaagtcgcttgcagctggccgttgacgggcggatacaggaagtggtgccgttgactgcgttggccaagcaaccgaatacggtggtgactgacttggcagccgggcctcatcacgtcaaggtgacggtcattgatggcagttatacctttgatggtgtggcgccgattctataaatacccttgcttgaagagtctattttaatcatgatcaacacgttgaaaaatgtctggaaaatgagacggtttgagtccgatttccaggcgtttttgcgtttttaggaagtgatggtggcgtggcaaaaagcagcaacattaaccgctaaaatgacgttaatcggccaaaacccgacgtttatttgttagatgacaccgcgtgccggtttgcgggtattataaaggggaaaatgttcattgttgcgtagtctatatttgagagcgttaaatgaagttgctagcacagacagaaataaaagctctcagtcaacattcgaaagtcatgaggtgagaatgatgaaggctttatacaaaggtgaacctgctgatatttgggaaataggcaaaacgacgcctcagccagattgggttcgtgaagcgtttgaagcgaattacttgtattggttggataatcatctgcgcattttgatgagtggtctgaagccatcgctgggcactaatttaaagataggggctgtcggcacgatcggcggcggctttgccgggtatggcatgtatgtcatgggctatccaggtgattacttagatatcaccaatcatcgggtggtttcaaagaaaaagtttttgaagcagtaccagcctattgacgatacccgtgtcagctgaggatcagttatagcacaagacgatgggactcgagacaggttcaaaggcaagatcgcacaaaaaagagcatacttagatataattttttatgttatcctgccaatagaaacgtgcgtgggcgcgacctatgagcagcgtccacattcgtatcaagaatgaaaagaaagaagatcagacgatgaatgaaaagttcctcgaagtgttgaagcacgaaggtcctgttacgattgttaccatcaacggcaacccggctcacgtggtcaatacctggatgtcttatgtcagccgcaaagacgatgaactctatattcctgcagccggtatgcacagtatcgaaggcgactttgctaaggataaccatgttcttttaacgtttggttccaaggaagttgaaggaacagttggacccggcgccggtttccatgtgtttggtactggccgatttgtcgatcaaggcccggcgtttacagccaagaaggaaaagtttccttggttaacccgcctgctgattgttcacgttgatgaggttcaacagaaaatttagcagaattgccgggttaagcctaacgcttgtgtgtagacgaggcgataaccttgctagcaacaagcatataaatttatacgcggataaaaataagattctagagggagtttgcctcaaaggatctatttttttgacattaaaaaaacgcaatccatgatttacatggcatgcgttccgtaagtccatataaataactttagccaaacattcgggtgacatcattttgaagcgtgtaatcgccattgaaccataaacgttaacaaggcgagtaccgcgagcagaatgaagtcaatttgactgccggttgcatcggcgccagatggtgataggcgattttgaaacgtgatgatggctgacaagctggccgttcccagtgatccggcgtattgctgaatggtgttgaacaaagtgttaatgtctgctttagccgggccggataccatggtgctggcgtcggacatggtgttgccaaagcccagattgaagcccattcggaagatgatataaaaaccgacaattaagggaatgctcaactggtgagtgaagctgccaagtaaaacggcaccgacaaacattgcggcattactggtgagtagcaagcggcgggcgccaaaacgatcgtaaagcgcaccgccaatcggtgaaaccgcagccccgatcagtgagccaggcaatagtaataagccagccactgaagcgttggtatgcaagacgttttcggcaaagatcgggatgacaaatgcaataccgatgttgctgaattgcaggatgaagaagttaatcgcacgggcacgaatgccagcatttttgaatagcgaaaaattaagcaatggcgaatgggtgtgttttaagtggcgacccatcccgatgatggcaattataagcgcgacgacataagcccaaaaggcaccggtcacgccggcagccgtaaactgatccagcacttcgatcagtgaaaagagccccagcgccagcaagaggaatccgaggaaatcaaaacgatccgcagttggatgtgctttgacccgaatcgttgcttcacccatgaaccagacaagtaagatgatgggcacgacaagccagaaaatcatccgccatgacgcgtagtaagttagcaaaccgccatatgtcgggcccaaagccggtgccagcgaggtgaccacgctggccatgccgacataaatgccaagatgtgcttgaggaatcgtggtcaggataaggtggaacattaacggcgtggaaaccccggtagcaagtgcctgcagcagccgaccagcaaacagaatcggaaaattcggtgcccagatacacagcagcgtccccgcaagcgcacagcaaatggctgcccggaataataagcgtgtgttgaagcgccgcaataaaaaagcggtggtactcatgaccagcgttaccatcagaagatagcccgaggtcagccactgaacggttgataacgatacatggagagttttgatcaaggttggaaaagtgacgttcatagaagtttccaccagaataccgacaaaagtcagcaagccggcagataaaatggctaattgcgtacggtgtgaaacaggtgaattcgtcataaggttgccttcgtttctatcaattaacctgatgcagcatcaggtcactgacgacgatagcagattccaaaaatccgcgcaaacgcaagcggtttcatagggccaaaatgaggagaagcacggtgaatgaaagcagtttgctgaagtgggttttgtctgaaagatacatatcattgcccccaacgtaaactgaaatgtggacgattaaactgaggccatcaatagccttattttgaacatactgtagttggattgtaggtggcagggtttatttgcgcttttttagcgtttgatacgttttctggttatacagcgtaacggtcatgaatgcttagccataaaggaagtaatgttttgccaagcacgttgagcctctggaatttgtggggtggaaatatagaaaatatggtacataccactaaattcgacaaacttaacctgaacatgagcagcgcgcgcttttttgacgactgtcgtactgtcactcagtagcagctcatgactacccgtttggatgagcatgggaggcaggcccttaaagttcccaaaagcaggtgataaataagggtctttcaaattgtgtgaaccggcgtaagtaatgggaaccggatatttaggagcagtcttgattgtcgatgaaccaaataaaggatcgctggtaactttcgtatgatacgagctgccacttgcggttaaatcagtccaaggcgaggccaaaacgagtgctcgaggtaatgcaagcttatgatcacggaggtatagggttaatgcaagtgaaagaccggcacctgaagagtcaccagcaattataatgttttgaggctgatagccgtgctgcagcaaccaacgatagccgtcaatggcatcgttcaatgctgcagggaaccgatactttggcgcagtgcgataatctaatgaaaaaacagtcgcgtgatgatccgattgtgagtaacgcagagcggcttggttataagtgttactaaagccgcttagataaccaccaccgtgaatttgataaacgactttttttgatgcatcgggctgcttttttgaaagtaagtaagcacgtgcatgcttgagatgaacttcttgatttcgataggtcttaggtggttgccaatcctggaagtggtaattagatggtgtctccatttttttaatgataaacgactcgccatgttgtgactcatagtggcgattaatcatctgaaaagcgttattaataagattgccagacaatgaaacctttagatttggccgagtcaaagcggttgttagacaggcaatgaagaacaaaccgatggagattaaagagatttgccaaagccgtactattcgttgtgattgtttcagataaattaaaccggcaatcaggataagcaggatgatatattcaaaagtcttgaccctcaagaaaactgcgactataaaaatcaaggcaaacaaaatcgcggtcatagcatagaaacagattgttttcttttttgacatctgaacgatctccttaataaataaacttattatgtttccaagtattaatgcccttagtctagtggcctatattaagaaaaagaagtatcaaaatgggcaggaatgttactttaacttgaaagttgggccaaaaaaggtcacgctaaaaaagaaggtgatcttgatgagtaaatttcaggaaacggatcaaaccatccagcaggctttttttaaagtactggctgctgagccttttgaaacaatcacaataaataagatctgttctgaagcaaaaatcagtcgaacaactttttatcgtcattatatggataaatacgcgcttcttagcaaggttaatcatgcgttttcttcggcactagcagcttatctacaacgcagaattcatcagacaaacattgcggatacgttagtcttgatcgccaaatatttatccaccaacgccaaacctattagtgacttactacgtgtacacacacccgaaagtgatctaagtgcatcatttcagaagattttccatgcgaaattcgctcgctatatcgactatgagctttccaaaggcgctgtgacggcttttccagttgcttacttgattgaactatatttggcaatcgcgatggtattcttaagttactctttaaaaaaggggctggacgttgctgttgttcagtcactaaacgattttcaaaagcaaattttcactgaaaaaagtgaaaattaggctaacagcggtggttatctcgatttagttaaccatttattgattggtcagcctacggaattttgggagtttgtacgacattcacgttgaactttctatgataagtgttccaaaaatgcccaaaaaacaacgttaatcggcaaaaaccatacgtttattttttaaccacatactattgagcctttcaggttatattggagaaaacaaacttggaaggcggtatgtgaatcatgacagaaaaagagcgtttccggaaatttgttcgcaatggatttcgaaaagatgaagaattgggcatcccgtatcatctatattgcctagcccatgcaattttgatagcagtcccgcttggattcattgtatccgcggtgttttatgcaatggatttgcgggacttatatggtactgtgtacgcttttaacatgggcgttattgtgtttttgatgtttgaactggacatcgattggcgcattgagaagaatgaatttttgcctgagcgagtctccaagttgcaatgggtcattcgtattttggcgagtgtgctcgtttccgggatcttcttttattttcatgaaacaacagttatccagcaatttgtgaagtaagaccgagcaacacattgcctgttgcatgttatgagttgacttgttccaaaatagggtaatcggtgcccgcctgttttcagggacgaaaaaaacacctgtcgcattgatgaaacgacaggtgtttttgttgctgctggcgataaggaccatcagttttatttgcaaatgttatagctgacaaaatgcactggttcacgcgcgagaatgcattcctgagcgagtgggcttagctgcttgtttaggcgtagttggggcaggtgtttttagtgaaggatcagcatgcggtccgggaccctcaggatgattgttttgcttcatttgcctgtcagtcatactgatcacactggacataaccagcggaagtaggaagacgagcaggatgagaccaatgatgacagccagcgcaacctgaatcaaagtggtaatgccagatggaatcatcgccgcgaacgtaccgcttaagatgatcgctgccgagatgacgactgcgccaatgacactggcggctttggtgatgcgttgtgtcatcgtgccaccttccaaggcattgtcacggtagcgaaccatgaggaagatactgtaatctacccctaacgcgacaagcatgatgaaggtgaagaatggtgtgttccaggttagcatatcccggccaagcacataggttgagaatagcttagtcaggcccagtgaggtgacatacgccattagtaacgttgaaatgatgctgataggttgaattaacgaacgcgtcacgacgatcagcgcaatgccgatgccgatgatcatgatggcggcggttcgttcaaagtcaccatttgccaggtcttgaagatccgctgtttgtgaagtttgaccgccaatggcaatagtggcgtcatcaagcggtgtatgcttcagtttggccgtcagatcggttttgatcgctctaatttgttgggcggcagcatcggtacttggatcgccttttaacacaaccgttaatttggtgattttattgttgtctgacatgtaagtcgataaggctggtttaaaggttttacttttcaaagtttcattagggatgtagaacttcttccccaagtatgaatgctgcagttcggtcagatattgtttcatactgatactgccgtctgcaatcgtgccaagggcttgatcggcggaagtaaggccactttgcatggcggttacttgttgcgagatcgctttgactttcgtattcagcgtttggacgccggtgttgacttgatcagcaccactggcaatttgcgcggcaccattcgtgagggtgccgttttgtgcggcgagctgagcggatccggaactgagctggttgaccccggaaaccaaggatggtacttggctgttcaatgagttaatcccactgtttagttgttgagtgccgttcgtgagggtaccaatgccgctgtttagcgcagttgtacctgcgtttagctgtttgagcccgttacccatcgcagcagtgccgtcatttagtttttgaacatcggtagaaaattgattgatttcatttaaaatcggctgggttaactgatcggcgctggttagaccattgattttagcaatgatatctttggcaatccctgctacgccttgaagctgatcattgagagttgccataccagtggttaattcaccggatttgctgctaagttgactcatgccgttagcaagcaccgtgctattgctatttaaggtgctcatacctttagctagttgcgtcgaaccggtactcaaggtgttgacacctgagctgagtgccggcatttgatcattcaattgactaaggccgctgtttagggatgttacccctgacgtgtactggcttatcccgctgttgagactggaagcaccggaagacaacgttgtggtaccgtttgccagtgtctgaacctgttgggtacttccggcaacattggcatttttgatttgggtattggcatcgttgagaccagcctggacttgcttcaagcctttaacactttgagttaagccggcagtgatggttttcagctgatcgtttagatacaacgatttaatcttactaccgccgggctgggtcactgaagcaacggttttgacgcctttttctttttgcaggtagttggttaggtcgtcaatggtgcccaaagtggtttgggtgttcagtgcctgcttgctttggatatagatggttgtcggtgaagccatgccttttgaataatgatcctgaatcaagcggtagccgactttggattggagggtttccggtaattcatcagcgttgttaaagttcagcgtctggttgacgttcaacagaaacggaatggcgacaatgccgatgacgcccagtgtgatgagcggccgcgcgatggcaagcttggaaaggccatgccaaagtttgcttgtgctgtggccgttgaggttcttgctgggccagaatagtttttcgcccatggttgccatgaagaacatgtttaaggttagcaaaacggtcaaaagaatgagcacgccgatcgcaaccccaactgcggaccgatagaacttgaagttggcgaggccgagcacggagaacccgatcagaaccgacagcccggaatatagaatcgttcgccccccaaaacgacgggcgattcttgctgctttggtcttgggaataccttgcgacagcgctgctttgaagtcatcgtatagcagaatattgtaatctgtcccgatcccgaacaaaaccacaacgagaaagacttgggtgaagttggaaatcggaaagttaactttgtctgccaaggtcatgatgatgtttagtgatgttaagaaagaaatcgccacagttagtaatgacactaacggaacaattggcgaacggaaaacgatgattaacacaatgaaaatgaagatggccgcgataatctcggttttttgaatgcctttttcggtcacgcttgcaaaatcatcattaaggacatcgctgccggtcacgtaggttttcacatggctggttttgatttgtcgttcgagatcgcgcgtctgcggaccaacctggcctttcgctttaacgtcaaccaatgccatttgggtcgtgccatccttggcatcaagctgctttttggtttcggcattatcggatgacttggtgacgttgatgattttaacggctttggagtctttgagtttggctaaagtttgattgatcgcgcgtttttgcgttgtcgaaagcttgtcgtcgccgttactgaagacaagggcaaatgagcgcaccttttgattatggttggcttttttctcaattgtcgcggcaacttggctttcttcggttttaggaagtgataaggcgcctttatcgcgaacaatgccggatacgtcgggcatggttaaaagtgccaccaaaatcacgacaagccagaagataagtgaggggatatggcggtcgtgaagctttttcaattaaacacccttctttcacttgtgaggccattccagacttgatttttcaagtccgcggctaatggtttctgattcgagacatgaccttcaagttgctgttgggcccagacgatgtcgatcatgctgacaatgctgccgtacaaaatcgccagctgcgtccgaacgtcggctttgacaatcacgccgcgctcctggccttccagcaacatgttattgatgagcgtaatcacccggccacgcgcagcacgactctcagcgttaagtgcctcgttgaaaacattttgttgaataaaatgcaattctgtcggatattgctccatggacgcggtcgccgcatcgaataagcgactgaaagtggtctccggatcatccggttggcagtttgccgcggttgccagggagtcgtggaagaagttcataatatcggtaaaggcggtattaagaatatcttctttgcttttaaaatgccgataaatagtgcctaccgcgacttttgctgctttggcaatcgagggcagattggtttcggcgtatccacgctcagcgaagagcttcaccgcctgcgcgataatcggacttggtaatggaatggctgtcatgatattttctcctttaggaatgaacgttcattcacatatattagtttttgagaatattcatgtcaagtgcatattcaaaaaataattaatactggcgtggtgcgttattgatatcaaactaaaaactcgtttaatggcgcagaggtcagtttgcgcccatacaaaaaaagcgttgaaaaaacaacgctttattcgagactatatttcttacggccacaatttaatacagccgagaataattgaaaaaatcgcggtgccgtttttcaataggcgcccatcgattttcgggccgatgcgactgcctacgatgacaccaataccgtgtgtgacgatgataattgctagtagcggtaaggtggtcatgaattggacttggctgaggtagccgactgcggccggtaagctgatgaagaccgagtttagcaaggcgatgccaactgctgcatgcggttcgcagccgagtaaaacgagtagcggcatgaccagtaccgggccgcctgctccggaaagggcacaaatcaatccggtgacaacgcctaggatgacgagcaaaatcggttgattcaaatgattgacgccgggttttggcgggtggcgttgttggatcaaaatagcaatgccggatagcaggacgaccagataaagtaagaattgtacccagctggtcggcagtaatagattaaggcgtacgccaataattgccccgacaaagctgccgccgctgagtagataagcgacccggcgatccatgagcccttcatgttgataatgacgcgagcccaaccagccggaaataatgaaagccaggaaactgaaggccagaccttccgtagtgctatagccgagtcctgcggtgtatagaatggggagtaaaaaaccagccacgccagtcataccgacgaggccgccgattaagatgttgccaattgcgatgatgatgattgccataatgttgggtaacgccgcgcacacgcagctttaatcccttctacgtctaatgttaacacttctcggttccgcatcagccatttaccggcaaccatcgaatccgcgacatcattagcattgacactttcaagcaacgtgttattccagttgccggttggccaaaggtgggggctatcaatgtttaacccgatgatatcagcctggtaacccggtgcgattcggcccagatgaccggatagattcagagccgccgcgccaccatccaagaccatggacataattgtcggggcaggcatgacagcaggctgatgttgcaaggtgccataatgcagcgtcataacggcgcggaaaattttcatttcctgccacagactcagaccgccatgcgccgcgccatcggtacccaaaccaattgaaacacctgcctgtaataattcaggcgtggcagggatgccttttccggcgttactgaacggactgtgactgagcttgacatgatgggtttcgatgagcattttttccgtgtcgtcaagaaacagactatgtgctcctagaaaatgatcgcttaatgcgccgcgttttgcaaggtagacatatggccgctcaccgcagcgcgctaaaatacccgcgacttcctggggatactcgttcatatgcgcttcgagaaaagtctgacgatctacggcgcgctgggcggccagatcgactaatgtatcggaacaattatttaaggcgcgtaatgagtaataaacttgcaaaaggttgcggccgtggaattggtcatacaaggcgtcggtgtgggcgatggcggttttggcatccatgttaatagttgcgggtaacgtcggatcatccatcgttgagtaggcaagggcgccgcgtaaaccactttgcgcatacaccgtgccggctgcggccatgtgatagctgcctgactcaacgaaaccggtggtgtcgctggtgatcatttcaagggcggctaactgggcattaagcgtcatggtttctgccgtcatgttggcttcaaatggtagcatgactttttgccagataatgcctttcgtgtcgagtacgcggccacgtaagagttgttggccggtatgtaagtgactatcgatcaagccgggcataaacagccggtgtgagccgtcaatggtttcatctgcttggacggttatcgtcccatggtcactgacctgcgcgattttatcgtcgcggattaaaatatcttgatgcggcttgatctcaccaggcgcggtcatggttaaggtatcctgaattaatgtgctcgtcacttaaatcacccctgtcagtttcaacgtgagcgtatcccacagaagcgaaccgacaaatgttccggtcatcacggcaaccccgacaatgatgtacttccagccttgatggacaaatgtgcccagcttatccgaaattgcaatgccggcaaacgagccaacaacggtaaacggcgcggcaaacgcaatgactttggtagaactaatcacaaccgcagcaatcggtgaaaatggtgaggcaacgagtaggcctaaaatggaacagtacgcaataatcggcaacttgaatggcacaattttagctaagaccacagctaccatggtaacggcaattaaaatgatcacgccggggaggcttttagcgatactgacgccggaaccgatccagttggctagcagcgtcccgaccccacaaacgctgaggagaaataaccattcacgtaaacgcattacttaatccgtcctttcaaagcggttgccgttttagcgcggcgactggcgaacattttatcgaaaagattgtagagcttgtcggttagcgggatggctagaaacagggtgatataaatcccggtgatgccggcgatggtgttggcagctgaagccatggcggtgatggtgttggcatcatgcgggaatagttgcgcaaggctggcactggcagaggccatgaaaatgccggctccaacgcctgtcgacatccccaacgccttgggatcaaaccaacctgtcagtcccaaagcagttgccatcatgccgaaataaatcgtgccaagaataccgccaacgatgtaaatcgccatactgccgcttgcttcatcagaatccgaaccataagccgaattgattaaggcaaggtgatattcgcgattcagtgaacttgttgcgccaattgcctcacggtgcagccccagcaacattgccagtggtaggccgaagaagatcccgagcagattaccgaagccgtgcaccagcaatgccggaccagcatgtaagatcatgtccatatttgcgccggcagtaattcctaggttcacgacaaacgggcaaataccaacgataaccaatttggaagcagctttaacatggcgattgtcaaaccactgcatcacttgcggcccactgagcataccaagaataatggcataaaaaaccgggaataaaatgatcatgccgggaccgaccttgagtttcaccgttccgatatattcggcgatgacggtgaacaatgctgcgacaagataactcttccattcgactttgatccgtgcacgtaaactgggataagtcatgttttgcctcctcttttagcgaatggaaccagtttagcgcagttattcgggtaaataaaggacaattacattaaaaaacgttttaatgttcgcgtttatccgtcagcacctgatggacaaccttttaaaaatgaataagtgacgagcatgacaaatcatataaaaagccaaaagtcagttaccttgaaaaaccgaatcaagatccaataacgaaagatcaagtgctttctgtatttggttttgattcggcaaagtttcctgacgcttggcgatggtgctaagtagctactgtgatcagttgttgatcacgcaattcaataacgttatttgctgtatttagtcgtttttggccgacttgttttgaccttttgttccagattctgctcaggtaggctggctggctcttcgtgaaacagacggggcaggtggcgtggcgcaacagtcgatactgacgtgacaacctgttgaacatgctggtttggctcggtggtgggattgacggttgttgcggccgatccgctgctagtcaacaaccccgcggcaaccgctaaaaatgtaaagaccatatgcaaaactcccttcgactggctgacattctttaataacagcgattaacagtcagtttagtaaggagatgtgattgatttgccgcatttgtgaggtcttttcacaacgaaaatgaaacgaaaacatggtgattcgttaacagaagcgtaaagcatggcgaatatggaccaaaagttgaagaagtatggatgaatcacgcgccgggcagtaaaaaattttgaacatgaaaaaagacgactcgggtaagtcgcctttttactgtttgctcgttttcaattatgaagcagattttccttttggttccaagcgccgttccaaaaagcctaacgccaggtcggagataatcgccattaaagcggttggcaatgccccggcgagaatgatcgcaccgccattggttgcattggtaccgcggacgatgatatcgcccagaccgccggcacccacgaaggcaccgattgccgtaatcccaatggcaacgaccagcgcgttacgaatcccggccatgatgactgacatgctcaacggaatttcaaccatgtacagtgattgccagcgggtcatgcccattcctttggcggcatccatcaggttcttgtcgacattctgcattccggtgtaagtgttcttgatgatcggcaacaaggagtagagaaagaccgttacgatgacggtgttcacgccaagaccaagcccgagcatgatgatggacaacattgccaaactaggaatcgtttgaattacgttggcaatgccgattaccgtgttgctcaaggtgcggtggcgagcaattgccaagccaaccggaatcccgatcacggccgcaatcagcacaccataaattgaaatcagaaaatggcgagcaaactgactgagcacgtacgaaccgttattggcaaggtaataccagaattgctgccaagtatccatgttagccattagtcgtcacttcctttgaaataattgtgtttagccagaaacttctgagcgaccacattcggttcaagtaattgatcgtcgacttgatagttcaactcctgcatggttttcagattgatcttgccgtctaaacgatgtaacagcggttttaattttggatatttcttcaaaagactgttgttaaccactaatgaacactgataaggcgggaagaactttttatcatcctttagaatcttcaaattgtaactgcgaatgcgaccgtccgtagaatacccgagaaccgtctgcatccggttggcttcaaccgcgtcgtaaaccaaaccgatttgcattggataaacgcgtttgaaatcaaatccgtatgctttggtgaagtcactgtagccgtcgcctttgcggttcatccagctagagtcaaccccggcattataacgtgatgcgactttctttaagtcggaaatgttgttgaggttatccttcttggcttcttcttgggtaaccatgaaagcataggtgtcagagaagccataagacggataccatgtttggtcatagcgttttttgaattcacgcttgacgatggtcatcgctttggaaggacttttgacagggttcatgcctaatgtgccggtgatatcggtgccggtgtatcgagtcgcactgatatcagcatcattacgaatcatcgcttggtgaaccaccgtcccggaaccaaggttgttcaccaaagtcgtcttgtaaccgagttcgtggttgattaattcggcaatgatattcgccataatctgtgactcggtacttgtttgggaggcgattcggacggtaccgtcattaccggaaccgccaaggccagggaagccgcaaccgcctaatagcagcaccggaatcagcaatagggtcaggagtagttttctgaatgtcttcatcttgccacctcctaagcgcgctcgctgacaggtgtcaggtggtattccaaccgccctaacaaccaatcaacaatcagtgccaaaatggttacaggaatggtcccgccgatgatgagatccggctggaagagattcagaccattaaagatcaagtccccaagtccgccagcaccgatatacgatgccagggttgcccatgcgatgacataaatagcagacaagcgaattcctgccataatgactggcatggctagcggcacttcgacttggcgaatggattgcatggcggtcatgcccattcccttagcagcgtccatcaacacgggatcaacatcttccatgccgatgtaagtgttacgcaaaattggcagcaacgagtagatgaacaatgcaacgatggcaggtactttcccaatcccgaataaaggaatcattaatgccagcaaagccaacgaaggcaccgtctgtaacatgctggcaaggccgatcacgactttagccgtcttaggaaaacgggtcagtaaaatgccaagcggaacggcaacaatgaccccgagtccaagtgcaattgccgagatgtaaagctgttcccaagttttggtaatcagttcactgccatgtgcgtttagaaatgcaaacatggtcacacctccttaggtgcgtctcgggtatcttcagttgccgaagtggtggtcgtcgacgatgcggctgactgatcgttattcttggccgcagcactgtcttgatcatcttcattgtcgccccaaatggtgtcataaacgacatcaacaagtgaggcacgggtgacaatgccgaccagtttctgatcattgtcgaccacaggcacatacttaaatccgcgcttaagaatgcggtcagccgtgtcgcgcagtagggcatcttttttcacatagaaaatgctggacttagtgatatcactcacactggtggcgctttggtaacgggtttccaatgattccagatcgatgaagcctttgaggtgatcctcgtcatcggtgaccagcagcgtatcaacgcggcgtttgcgcatgagggaaatcgcttcagccaaagacttgccaggtgtgatggcagccggattcttcaacatgatctgttcaacagtggtgacgtccgcccgcgcttgaaccaggcgatcctgaccgactaagttttcaacaaacttgttggcgggatgggtcagtagttcggttggggtggcgttttggataatgtgaccgtgatccatgacaacaattttggtggcgagtttgagcgcttcgtccatatcgtgggtcacgaaaacaacggtcttaccgagcttttcctgcagatttttaattaattcctgcagtgcttcacgggtaatcgggtccaaggcgccataaggttcgtccattaagatcagatcctgattggcagcaagcgcgcggataaccccgatccgttgttgttgcccaccggaaagctctgatgggtaacgatccagataatcttcgggtaattcgacgagatcaaccagttctttggccttttcccggcgcttttcttcaggccactttaataatttaggaacgatcgtgatgttttcataaatggtcatgtgtggcatgaggccgatattttgaatgacataaccgatttgacgccgcaattttacggcatcgattttgtgaatgtctttaccgttaaacaggatttgaccgccgctgggttccaacatccggttgatcatccgcatggtcgttgtcttcccggaaccggatgtcccgataagacatacaaattcacccttattgatttcaaggttaatatgttcgaccgcgacattcccgcctcgatagactttttcaacgtccttgaacaggaccattggttgttcttctggcatctgacgcgtcctcctttgtttggttgcttctatgataacacatgaagttaatcgttttttaataaagccaaaatgccaaaaatgcctgctgcctgcataacttttcagttacagcttataaaatgattaaatgaaagtcgagaaagttcctctgattagcgaactccgtgggtcaacaacaagctgacgagtaccactgctccgtagcccagtgccaatcgggtttggccgattgcaacagcagccatcgctgtgccgccaaaaaggacgatttctgcgatgagccgttgccactccaccagctgaaatggcgatctgggtgccatccagcgcccccaggcgagcagcaccgcaatcgggagcgcaacgccgccaattaaccgaccaaccaacgaaggaaaatgccaacccgcccaaatgagcaagctgacagtcgcaatttcgaccaggaaccgtaaaccgtcaattaatgatttaatcatccagctcacccacttgattgatcaagtcgttgacctgttgcggattattggttggtttttcgatttcttggctgatgcacgccagtacggtcagaagaccttggtagaaccgcgcttgcgcagcggcatcccttcgtttcgtctggataaaggcaagcgcctcgccgcgacaatcggccgtgattggccgctgctgcaaggcaagtaccttttggcactcgactaggcttagccctgcccgcttcaaattgatgatcacttttgctgtcgccgcgtccgtatgattgtagcagcggtaattgcctggtgtccgggcggggattaataattgtttcttctcgtacaggcgcagggtatcctttgataacccagtctcttccgcaaattcttgaatgttcatgcagccatctcctttgggtggtgtaagcatagcattagaccggggtcgaaggtcaaccgggaagacacaccgcgtattggttaaaaattgaacgcaatcaaggtgccatggatgctcccttcttacgtgacgagtaacaaaaaaaccgagatcactaaactgtgatctcggcttttatggcggcctgattcatcgtgatttaatcggttgataccttttccaaaggtacttgatcaatatgtaaatcgaagcacaggtaaccatgacgctcaaacttttgaggatggctacgaatagcatattgtttggccaaaagttctcgagaaatttgaaggcaatacgattaaaaataacgaggaaaagtgctgcccaaacttctttgtcttttttcatgaagaatcctccgaaatcagctagatgatttggtaacattcgaaacgcaataaatagtgagttatataaaaataagataaatacttgagtatgaattctattatagaatagtcgactgctgaaagacaagcgttgataagtcgacggctgcctattcttgacatgatactataaaaaaattactttatttgcgtttcctttgacaacaggacacaggttagacattctttggcattaatacaagatctacaccacatgggatctttatcagttgtggctcactgcatgatcaatgtcactgctttgatcaggcaaaactaacattactacttagttcgccaaaattgatcccggtcaaggtaaaaccagatgcttctcggtacactggtctcgaatggagggatcagcgatgcgttttattcaaacacataaacaggaagcgatggtgatcggcggtgttctgactgcggcgggattgattttcagtcaggcatggttgctggtgttggcgagtctggttgccggcctgccgattgcggtgaatgcctgggaagcgctgcgttataagcaaattagtattgagctattggtgacaattgctttagtgggcgcggtgatgattggcgagccgattgaaagtgcggttgttagttttctatttttgttcggtgactggttggaacagcgtagtttagccaagacgcgctcggcgatccaaggcttggctgccgcagcaccgaaaacggcccggctgctggatgggacgaccattccggtggggaagttagcggttggcgatcaagtgcgggtgttggctggcgaaacggtaccggctgacgggcaggtgattagcggccaggcaaacattgtggaagccgcgatcaccggcgaaccggatgccaaacgcaagcaggttggcgccacagtatactccggtacgcaggtgagcgatggcacggttgacattgaagttgaaaaaaccggctacaacacggtttatcagcagattatcgatttaattgaagatgcgcaggacgcccaatcgcctgtagcaaccttcatccagaaatttgcccgttggtacacgccgctggtattagtcatcgctttgctggtgggattgattagccaaaatgtccggctggcgattacgattttggtactgggttgccccggcgcactggtcatcggcgccccggttagcaatgtggtcggtctaggatttggtgccaaacatggcattttaatcaaaggcggcgatgtggcgaccaagttggatcaaatcgacacggtgatgtttgataaaaccggcacgctgacacaaggcaagatccgtgtgacaacggctaagtattggaccgctgatcagcaacgggttgcagctatggtagcagcggttgaaaaagcaacggcgcatccactgggacaagcacttgttgctgatcttcagacgaaggccttgcaaaagccgaccgatgtcaaagtcactcgcggggttggggtgaacgcccgaatcgccggacacgcgatcagtgtcggcaatcaaaagattttgcaccagccgctaactgctgaccagcaggctgatattcagcaaatcgtggccagtggtgcaaccttggtcttggtaaccattgacgacaaactcgtggcagcttatggcttgcgcgatcagttgcggacggaaacgccaaccatgctgagcaccttaaaagcaagtggcaagaagacaatggtgctttcaggcgactcgcaggcagcggttgaacacatgatgtcggcactaccggtgagtcagacgcgcggtggtttactgccggcagataaggtgaaagcgatcaaagcagcacaagcccgcggtgaaaaagttatgtttgtcggcgatggcatcaatgacggcccggccttggcacaagcagatgtcggcgttgcaatgggttccggcatggatgtcgcaattgacacggcagacgttattttgaccaacagccgtctcacaaatctcggcgtgcttttcgacttagccaagcggatgaatcgcaacatcaagcagaaccttgtcattgcaattggcacggtggcgttgttgttaagtggcctattgatcggattggtcgacatggctagcgggatgttattccatgaaatttccatcctgctggtcattgcaaacgccttgcgattacgacacacaccaagaaaatggcaaaacttgacggccatcaaggtacgtcatccgcaaacggttaataatgagaataaataaaaacgaaaggatctttaacatgacaaaattagtttatcaattagatggtttaacctgcccgagttgcctacagaaaatcgaaggggcactaagccaacaagccggcgtcaaaaccgtcaaagccttatttaacagcagcaaggtcaaagcccagattgatccagccgtgaccaatgccgatgcgttgaaaaaaaccatcacggacttgggctacaccgttgtgaacgttcgtagtcaagaagcatagagcgtgagcaggagcgcttagcaatcggagtgtaagcggccttaagcctaaatggccggtctttggccatttaggcttaaggtccttacgcgcagattgctgcgactgcgaacgcgttttagaacgagcgtaagcagaaacacctaacaaacgtagcacaagaggttttaagcgtgggccgggctttaatcatgacacccaagacctttacacccaggcttctagcgcggcaaacgcattttcaaggaggaaatcatgagcataacaccaggcatgcacactattgccgaagaaacagtaaaagcccaccaagcagcggcagctaaacaagccgaccatgatcatcatgtaccgacagctggggcgatgagcggacatgtactagcaaatttagcagtcttgcaacgtaaactggcccaattttcccaaacgttgagtggaccaagtagtgacggggatcgcgaattgttaacgcaattggcaacacaagcgcagcagcatctgacggtgttagtagcagacttagcggcgcaaggagaagattttcccacgacaaccgcggagtttagcgagtacacgatgttgcaggaagatcccgcgtttcgtttttggaccaatgatatgaaactggatgctgtggttaatgatctggatacttgccagctgttcgtcagtcgggcgattccgctagccaataaagagaacaaggcagtgttggcagcggatatgttacaattgcagcgctggcatgagcaaagtatcctgcacttgcaaacgcgtctcggtcgtgaggtgacggcggggcggaccttgcttgaagaggacgatgactgagcaacattaaacgatcgattgacgagagagcctgtctgtaagggggataaaaatggcgcatagttgtacggcggtcgtaccgttatttaaaaatctaactgatgaagcccgcactgcgattgatgcgttgacccacgagcatcaggtgcaaaaaggaacggttctgatcagtcctaacactgctgctcatttgttagtggtcgcacagggaaaactcaaaacttatcaattggcgacaaatggtaaagagcaattactgcgcgttgacggccccggtgattatgaaggggaagccggcttgctgaatatcgctaatccgaatgtctataccgaagcgctaacgaccgccaccgtttgcaccattagcgctgccgattttcaacagttactcatgcaacaaccacaaatcagcttgcaattactcacagaaaacgcccgtaaaatgcaggcattggaaaagcaagcgggctatctcggcaacgattccatcaatatacgcttaactcactacctactggatctgcgcactgccgctggaaaagacacagtgacggtaccgatggcatggacgcagctagccgattatctcggcacaaccccagaaacggtttctcgcacgttaaaacggttagctgatgaaaaattgattcagcgaactgggaagcaagtaacgattttgaatgctgaggatatggaagattttgtttggtagggttgtcgttctaaatataaaaataattaaaaagccagtgagcaattgctatgtcgcttaaagttgaaacaaaacttttgggacatgtggtaaatcactggcctttttgtatagtcatcgtttaatctcgcagatagacaagatgatctttaaggctgttgatgatgattcgggttaacttttcaggatcgatgaggcggtctggcgttaaatagtaaagaagaatattccaaacgccgccaataatcagcaagtcaatgaccgtttcatcctttgttggtgaatgccaaggcatcgcttgttggggaagcatctggagtagctgctgccgttgagcttcaaaaacaaaacccagcaagttattcttttgcaatactaaaagttcatgccgctgttcttgccaaaatgaaaaatagcagcacagtaaatcgtgaaagtttttgatcttttggtcagcaactttggccaaatacgcttgaacggtactttgcgtgtaatactgaataatcgcgaacttgctgggaaaatgttgatagaaagtttttcgagaaacatttgcttctgccgcgatctctgaaatcgtcaattcgttaaacggatacgaggctaacttattaaataaagctgtaacgattgcctgttttgatcttaaagcagttttattcataattactgacttccttcaaaagaaaagtaacataaacgtcaatatgtcaccattatctccaaaatccttttacatcgcatgaacatattctacgctataactgtaacaaatgttacgttttgaaaggagtttggaaaatgttacttgattattggatgttaccaattttgttcatcttacatgattttgaagaaatgattatgatgccaatttggaagcggcagcacaatcagcggctccggaaaatgaaaaagtccttctttggtgccgtgacgaatggacaagccttttcagtgggggttttagaagagttaatcattttaatcggggtatcgttagtcagttcggtactgcacagtgatcgtttatatctggccttcatggtgacttatacactgcattttctcatgcattatcgaatgtgctttgaatttcaaggttacgtgcctggggttatttctgtcactttggaactaccagttatgatttggttgataacgatttattggcaacgaagtcagagtacgttcggcgaatttttgggctatgtgactgtagcttttctcattcagtttgttaatttacgtgttatgcacacacttatgccaaaaattcaggcaaagatggcagcctatacgaggacgtcattgctttagtaagttttccaaggcgaataacaacaaaggacacaaccggttttggtctgcggatgtgtcctttgttgttatcagtcaggattagcaatgtgttttttcatgccgaaataataggtaacaacggctatcattgaggccaaagtgaaagcagaaagatatatctggctacttggcaggaaataccaagccgaaattgctaagagtatgcctgtgatcaaatagagatacaggaagatgcgggttcctttcaaattggcaggcttcgttacgagaaaatagaggaaaaaagccgaagttgcaataccgaaaattatagaagcgatgtgtaataacatgtttgagcctgcctttcgatcgggtgttgctgtaatctcacagaacaatcaaatattgaaaataaccgttaaacggtactagttcgccgataaaaccggatgcgtgcgtcgtttttgccagaagagaaggataatccccagtaagactaccagcaatatatggacaacatttgacgccacactagcctcaagtccaaaaacgccgccagtcagtgactgcgatgtcgttgtcgggagggactcgaggacgaacttttcaccggacagcccggaaacggttgtgccaaagatgggaccttctgcaaaattccacatggcgtgaaaagcaccgcacagccagatgttgcctgtcagtaagcgaaattgtgacattgcaatggcaaagaaaaacaagccagtggcagcggaaaaattatagccgggattggcaagatgcaaaagtgtgaaaaagatggcgttcaacaaaaccgccagcccgacacgattttgtttgagccagtagcccattatatatccccgacaaagcaattcctcgaacatcgattgaatcgcatagccgaaaaagaaaagtgccagccacagcaagtttgaccattggaaagtcgccagcacatggtaaccgccaagcaatgcgatgatgccccagatgaggctgaacatgagcaggccaaaaagtaagcctaaagcatagtctctaacggcatttttacgggaaaaaggcagcaatgtacgatcactgcgataatagatggccatgccgataatgccgatagcttcagcgtataaaaagagcaggttcaaagacatcgggatgttggtttcatctatgtcgatgtcgaacagacccatcaaaaaaggaatcagctgtgatgacaatgaccaagcaagtgcaatgccataaacgattaggataggtcctaatagctttgaaaatttatgtagttgtttaattggattcacctctgaatagaatttgaatagagaagatagcttaacaacaaaagaatatttttagggtagccttaatttttagcgtagtcaagcgatccaaaccgagttaccggtgaacgcgttataggcgcaggcggttcatctcacttgaaataagtatcactaacattcggaatactggtactagtacccaaatgtgcgaaaacgcttttattgtccttgctattccgttagtcttcatattgaaaataaatagataaggggtccagcaatatggagaagaagattgttgccgtgacggcttgtgcagcggggattgcgcatacgtatatggctgcggaatcactggagcaagcggcgaagaaaatgggctatgagatcaaagtcgaaaccaatggggcaatcggtgctgagaacgtgttgacgaagcaagatattgagcaggcagacatggtcattgtcgcctcggatattaaaattgatccgattcgatttaccggtaagcggcttttcgttacccaatcaaaccaagcgattgaagattcggaggcattgatcaatcaggcgtttgaagaagccaaaatttttggaaaaaaaggtgcgaaggttggcaagattcaggtaggtaacgataaagataaggtcaactttttcacgcatattatgagcggcatttcatacatggtgcccatggtgattgcagccgggttgcttttgacgattgctaatctgtacgcctttcaaagagacgatttaggccgaattgttaagtggggctttgacaataaaacgcaaatgggattcttgatggccaagttgttctatgtggggcaaatcggctttaagttgatgattccgttgtttgccgggtttgtcgcgaattctattgctgacaaaccagcgattgccccggcgatgattggcgcttatttggtcaatgatcccgagtttctgaatacgaaggcgggcggcggttttattggcgccatcattgttgcctttattgtaggttacatggtgaagggcttgaaaaaagtgaaatggccaaaactgctggtgccgattgtgccaatcatgatcattccgtttatcgccaccgcggtcattatgttgattgttctttatgtcatcggaaacccgatcgcggttggcatggatgcgatgtataaaggtttgacggatctcaataacaactattccggagcgccgattttgattggcgctatctgcggggcaatgatcgggtttgatttaggtggaccgatcaataaaacggctttggtctttggaaccgcgattttcacggatacgttgaccaagtatgggattaacggggccaattttgttcctggaaccgcgacccaagcagcaatttccgttgcgccactgggagtttagctggccaccatcttattcaaaaagaaattcaccaaggatgaaaaaatcgccgccagtgctgcttttgggatgggaattgtcggcgtcactgaaggcgcgatcccgtttgttgccgctgatccagtcagaatgatcttctctaacgtggttggttcagcggttgccggtggtctagtagctgcgacagggtgtaaattttacggcggtattggctcgccactgggaacttttattggctatattgaacagccgctaccgtttattacttggatattatgtgtctgtgccggaatcctgaccgccgcattgttaatcggcttcacccgcaaacaaacagtggaaggactcgctgttgaacccgaaaagtaacgctaaccgctgaaaccgaaaaatgaataggtaggtagaaaagtgaataaagaagtttttaatcgcagccatattttatttgatgaaacggcaacaacccaggaagaagctttcaaaagcctcgccaaatttgcttataacgcaggctttgtcgctgatgaaacagcctattttgaggggttaaaagctcgtgaaaaggaagcaaccaccggctttaaagatcatatcgccattcctcattgcaaaagcagcgtcaataagaaaccggggttattcttaatcaaatttaagcaggcaattccgtggcaagcattagatcaaaagccagtaaaggtggcttttggcttgaccattccggaacaaggggccaccgaacatttgaagttgctaagcctgattgccagaaagctgattgacccagactttagagaaggggtcctgacgcaagatgatccagaaaagctgacagcaatcattgatcaaatcgaatttaggggttaatgcagaagtgaaaagaaaagttcatgtcatccatcacacccactgggactttgaatggtatttcactgccaacgagtcactggtgcagttggcttatcatttggatgaggtcatgcaagccttagagcaacagcaaatcagttactatttgctggatgggcagatgagtattcttgatgattatttaaccagttttccagaacaaaaagagcggctaatgaagttagtcaaaagcggcaaactcgctattggtccttggtatacgcaaaccgatgaattaatcgttcgcggtgaatcaattgtcagaaatctgaatctaggcatgacgttagcaaaatcattaggtggctacatgaatgttggctatttaccggattcttttgggcaaagtaaagacatgcccaaaatctacaatggggttggcattcagcaggcagtcttttggcgcggggtgcctgacgatgtgacaacgcagcgtgaattttactggcaggcagaggatggttcccaagtcttaaccgcgaatatcaaagatggctattttgtgggcgttggtctgatttattctgatgatgcgcctgcccttgtcaaaacgattgcggccggtgctacgggtgcagatttactgttaccggtcggcggcgatcaacggtatattgattttaatttgcgcgatcgcatgaacctgtatcgccaagtgcttcctgatacagagctagaagaaagcaattacccggcgttttttgaggcaattaaagaaaacgagctaccaacaatcaccggcgaatttatttctagtgcagtctccaagatccatcgttccatttactcttctcgttacgatcataaatacttaaatgataaagtggaacggcgcatgatttatcaagtggagccgctgatggtgatggcagaaaaatgcggaatcccgtataagcaaggcttgctagatcgaatctggaagctgctgaataaaaaccacgcacatgactctgccggcgggtgtaatagcgacaaaacgaatcggatcatcactgcgcgctatgttgaagcagatcagctttcttactcattagtggattacctcaccagaaaaatttccgaatcgcgagttcaggtatccgaaggcgaattggtgatttttaataccttgccgtggacgactaaaaaggtcataaaatgtgaggtatcgactcactttgccgcgatcgcacttgaaaaagacggcgtgacgattccggtcgaatgtttacaaacacgcaaagaatcgaatcgttccattcgccgaaaagaagtggcggatgcaccctccaacgcttattacgttcatgaattattgattgaagcagaagtgccgccgcttagttttgtagcgtatcaggtggttgaaaaaaatcatacattcaccgataaaacgctagccgaaaacgcgaccgcttcgattgaaaatgatgcgtatcaggtgacatttaaagcaggcgaactatccttaatcgatcgcaaacgcaaaaccgtctatcagaactttttggcgtttgaagatagcggggatgaaggcgatacctatgattattcgccaccttatgtggatgatcggtatcgactcaatttgaatggtgctacttgtcacatgatccgcaaccaattaatggaaaaactcattattaccggtgagtggcaagttgccaaagacctaaaggaacgccaaactaaaaagcgaacccaggcaagcccttatgaattgacgattgaactattaaaaggcagtcgccagcttcaatttcatttggagctcgacaatcatgcgtgtgatcaccggatgcgggtgttgattgagacgccgaatcagaatgctttttcctattcggatacgccgtttggtacggtgaagcgagcggttgaggatcctcatattgacgattggcaacaactgggctggcgggaagaaccaacggcaattttcccgatgctgacgtatgtcaacagtcatgatgcgacaaccagctggacggtttttagcaaggggatcaaagagtatcaattcatcggcgaaaagtttcaaacgatggccttgacgttgtttcgctcggttggttatctcggccggccggatctgctaagacggccaggggtggcttcaggcaatgagtttaaagccattccgacaccagatagccaattgcaaaagaaaatgcgcttcaaatttgcactgcagttagatcacgattttcagccagcaagcttggcaaaagattatctcgactatgcgatcagcagcccgtattaccagatccaagacctgaatcgctttaccacaacgcttaagtattttgtctcgaatcctttaggccatcaagtgccaacaccaaaaggaatgacgcttgacagtgagacgctggttttcagctcattacgcaaaagtaacgacgaaccgggctttgatattcgggtttataatccggatcttaaccgggaagtggacggcggcactatcaaaggcttgcgtgatgtgcggtatacgtttgtagatctaaggggtcatgctgtcactgaaacctatgaagatgatacgattctcctaggcacctttaaaccgggtgaaattaaaacggtccatatcgttgaatgaggagaaaacgaatgccagaagatatttttattttaatcgagtcgtgtcggttgaacttcactgctgtggaacaggtgatcgccgactaccatttgagtaaacaaccggcgatgaccattgataaattatctgcgcacttagcggtgtcaaaagcttctattacgcggttttgtaagaagatcggtttgagtaattacaaagagttggtctttctttacaagctgtctttaaaccaggaaacgactgatttatccgtatcctcaaagatcacggcagcctatcattcgcttgcaacccgcagtgacagtcattattcacaagcagtcattgatgctttttgtgaacggttgcatcaacatagaatcattcatttttttggtaaaggcttcaattcttacgctggcgccgatttccagttcaagttttcccgagtcggcaagtatgtccgcgtaatcgctgatgaaaattcgattttgatgtctgccaattttgcgaaccaagatgagttaatcatggtggcgagtttgcgtggggatgacgaagagctgctgaaagcgatgaaaattgccaagcagcggcaagtaccgattctactgattacgtctaatcgttattcgcaacttgttgcccatgcggacgtgacgcttattgctgccagtttgaccaaagaagaggctttaggcaatatctcaccacaaattccgattttgattcagttggatatggtttatgagcgctatatccatttatatgccgatgccgtttctcaatggttggcgtcggaacaaattttacacaagtaacggaggaagcatgaagaaatttcccgagaactttttgtggggcgctgcaatgtcggcaccgcaaacagaaggccagagtttaaatttcggaaaatcagccaccatctgggattactggtttcaaaccgcaccggagaagtttcaccagcaacaaggaccagcgatcacatctgatgtttatggccagtatttaaaggattgtcaacgcatgcaggaaatcgggttgaattcaatcaggacatcgatttcctgggcccgtctcttgccggatggaaaaacggtcaacccacaagcagtcgcgttttaccggcagtattttaccgccatgcgtgatcatggggtcgaaccgatcatcaacctgtttcattttgacatgccgatgtggttgatggcgcgtggtggctgggaaagtcgggaagccattgccgcctttgccttttacgcccagacatcatttgagttgttcggtgatctggttaaaaaatggacaacctttaacgagccgcttgtccatgtggaatgcggctacctgtatcagtatcactacccagcaatagtcgattttaagcgggctgtccaggtggcttatcataacttgcttgcacataaagcagcagtcgcgaagtttagaaacacgctgccgtctggtgagatcggaatcattttgaatatttcaccgacatatcccaaaagtgaagcaactgcggacatgttggcagctcggcgctcggatctcctgaacacgcgtagtttcctggatcccgcagttttggggaccattccggatgatctagttgcgttgttaagtgaaaatgaattgctaccagtgacgaaacccgaagatcaggcactgattaaagaccatatcgtggatttcatcggcttaaattattaccaaccgcgccgagttcaggcaccaacagctcccaaaacgcctgcgcaaatgccggccgacttttatcagccgtatgattggcccgacaaaaagatcaatcctcatcgcggctgggaaatctatcccaaagcgctttacgatgttgccatgatgatgaaaaacgactatcacaacatgccatggtacgtgagcgaaaatggtatgggggtcgcaaacgaagaagcttttatggcggataacggcgagattcaagacgactatcgcatcgcatttatgaaagaacacttaaactatttgcaccaaggtatccgcgaaggcagcaactgctttgggtatcatgcttggacgtttgtggattgctggtcgtggttaaacggctataagaatcgctatggattttatcggctggatttagcgacaggccaacgatcaatgaagaaaagcggccgctggatgaagcaggtcagtgaaaacaatggattttagaggtgaccaatgagtctaggggtatttgatataggcggaaccacggttaagcacggcatttgggagcatcagcagttaagcccagtcaacgcttttccaacacctgtcacatttgatgaattactaagaaatatggccgaaattatccgcgatgccaagcgcccgctaacaggcattgccatcagcgcaccaggagcagttgaccaagaaaagcggaaaatactaggcatcagcgccgtgccttacattcatcaacggccgatttttgatgaattcgaacaacagctcggcttgccggtgacaatcgagaatgatgccaactgtgcagggatagccgaagtagaactaggcgtcggcagagaagcacaaaatattgcctttgttgttctgggcacaggagtaggcggcgcactttttgttaagcggcaactgtacaagggaagccatctgtatggtggggaaatcggcctgctgaaaagtcagagtcagcaaatctttagtcaaaccggaactttggtcaaagtcgcgcaagcttattctgaacaagttaatcgttcggttgatgggaaaatgctttttgagttaagcgaaaaaggggacacacttgcaaaatcggcgttggatgaaatgtatcagaccatagcaaaaaacctctataatcttcaagttctattcgatccggaaatgattgttttaggcggcggcatctctcggcagccaacattagcagctgagctttcagggcagttatttgagcaactaaaaaaagaaggcattgaagaaatcatgccggtcgtcaaatgctgccattttcataatgatgccaatctaattggggcggcgttgaacttccagaagattttccctgatcaggatcggagttaagtaagtttaaatccgagtgggtcaagttttatggcaactcttagccatcattattaagtgaagcgtgttgaatgattacctggaaatcccatagactgagattaagttcaaagaggagattgaatgactcttacagtcctcctaggtctttctcctttactttgcattcgagtcgttatattatcagaatgcttttatttaccagttaatgggtccatctcaatttatggcgaggaggatggaacatgacactgcttagaaaagttatttgggtattcgtgtttgttatttatggggtagtgcttttttgggcttcgttttacagcaacagtgcttattttttaccggtgatcgccatccctgctattttttcgggaatattttggctaatcgaaaatgttaagaaaaacaagaagtgaggaatgttcgtcttactgtgccactttggtttagcaagatgctttattgtcgattgatattacgttccgccctcttttgttgctttaactgaatgcttaagaagcggttgcttagaacgtaaatcaataaaaatgaaaaagatcgcagtactcggtttgagagtattgcgatctttttggccagtggctactttacggatcaagtctacttaaatcagacaacatttaagcattcctactaacgacagactcggtttgcttttgcgtatcaaccgctgcccgaatcgcctttgtaaactgctcaatcgcagcgggggcgttttgcgcttccttggcgacaatgtccacgatggcgctgccgataatgacgccatccgcaatcgacgccatggtttgggcttgttgcggggtatggataccgaatccgattgctgttggcacatcagtatagcgtttgatttccgtaaccaacgtttttagaccagtgaaaaattcgtcccgttcaccggtgatgcccacagaggaaaccacgtagatgaaaccagaagcacttttggcaattttttcgatccggtggccagaagtcggcgtgattaacgggataatatcaatgccatacttttctgcaaacggcacaatttcagcgcgactttcgtatggcaaatcggggatcaccagaccgctaacttttagctcggcgcaacgcttcaaaaaggcatcgtagccgtacttgaagacgatgtttaagtaagtcagaaacacgatcggcaccgcggtttccttccgcgctgccgcaacgatttcaaaaacggttttggtgcgcacgttggcagcaaatgcgcgcaggtccgcagcctgaatcactggtccatccgcaaccgggtcagaaaagggaatgcccaattcgacaatatccgcgccgccatgtgcaagggcaacaatgtttttgacagtggtatcgaagtccggatcgtccgcaacgacaaatgggatgaaagctttatgatttttgaagatggcagctaaattactcatcaacgtcaactcctttgtatttggcaatgctggcaacatctttatcgccgcggccggataaggtgcagatgatgatttggtccttggccatggttggggcaattttttcaacgtaagcaatggcgtggcagctttcgatcgccgcgacaatgccttcttgtctagcgatgtattcaaatgcctgaaccgcttcgtcatcggtgattccaacatattgggcgcggcctgcttcggcgagggcggcgtgttccgggccaacgccggggtagtcaagaccagcagagatggagtaaaccggatcgatttgaccgtcttcgttttgcatgaataaggatttcatgccgtggaaaataccgacactgccgcgttcgatcgtagcagcggttcgcgccgtatcaacgcctttaccagcggcttcaacgccgaccagttgtacagaaggctcatcaatgtatgcggcaaaactgccaatggcgttactgccgccaccgacacaggctacgatcatgtccggcagctgtccttctttagcctgcagttgttgcttggattcaatggaaatgacgctttgaaaatgtttgaccatctccggaaatggtgctggacccacggcagaaccgagcacataaaaggtgtcatcgctgcgactggcccattcctgaagggcagcgttgaccgcgtctttaagcaccatcgagccgctggtgacagaatggactttggcgccgagcaatgtcatgcgataaacatttaacttttggcggtcagtatcttcttttcccatgaaaatttcacattccatgcccatcaaagcggcgatcgtggcggtggcaacaccgtgttggccagcgccggtttcggcaattaaccgggttttgcctagatgcttggcgagtaaggcttgtccgataacattgttgattttatgggcaccagtatgattgagatcctcacgtttgagatagatcttggccccgcctaagtcttcggtcatgtttttggcgtaatacagtagcgatggtcgattagcataattgactaacaaatcgttgagttcggctttgaattgcgggtcgtcttttaaagtgttgaaagccgcggtgattttttcgagttcggtcattaaggtttccgggatatactggccgccaaagtcgttgccatagcggccggcgcggtttgtaggttgagcagtttcatttagtgttttcataagtgatttcctcttttgcgttttgagtaaattgatgaattttgtgcgcatctttgtgaccggcagtttcaacgccgctggacacgtcaacgatagtagggtggacgatttgaatggcacgggcaacattttccggcgtcagaccaccggctagaatcagtggccgcgcgatgtgtggaatagccactagattgagcagttggccactgccttttccgctgtcgaccatgagataatcagccggtgaagttaagtcaattgcctggcgttcaaagacctggatgacttgcaggccagcgtgttgcagctgcttaatttcggttggtgtacttgttcgatgcagctgcgcaatttcaatggcgccggcttgataaatcgccagaatatcggcgaccgattcatgaacgaaaacgcccactggttgaatatcaggatggagtaacttgcgtaaagccactgcctgttccagggtgacgtgatgccgtccgggagcaaaaacgaacccggcgaaatccgcttgagcagcattgatggctaaaatatcttcgggatgcattaagccgcagattttcacttttaccatttttcaaatccccctgaatgccgtaattaattcccgcttgtgcttggagcgcatgagggtttcaccgattaagacggcgttgaaaccggctgcagctaacttttcgacatcttgttgcgtttggatcccgctttcggcgataacaggaatcgagtcaggaaccatggcgcgtagtttcagactgtttgtaaaatcaacctgaaaatttttcagattccggttattaatgccgatgatttttgcgcctgattgcaaagcacgggtcacttcttcggcggtgtaggcttcgacaatggcttgcatgccgagatcctcagcgagttggcggaaggtgcgtaattgttgatcagttaagatggcaacaataagcaaaataatggacgcaccatttgccttggcttcgtaaatcatataaggatcaatcgtaaaatctttacgcaatgtcggcactgagacctgttggctgatcgtctttaaatagcgaagatggccgttgaagtaatcaggttcagtgaggacggaaatagcatcgacgccggcttgctcgtaagcttgagcaatcgccatgtaaggaaaatccgccacgatcgttccttttgatggcgaagcttttttgacctcggcgataacttgcaaaccaggctgctttaaggtggtgaggaagtctgattttgtggtcggtggttgatgggcaacgatacgttttagttcagttaaggattggtgttgttggcggcgagcaaggcggattctggttgctgcgacgagatcatctaagatcatgccaccacatccttacgtttggcagaaaaggcgagcaggtgatttaattcttcacgtgccttcccagcgtcaatcgtttccgcagcgagagcgatgccgtcttgaatgctcagtttcggatgagccagatgcagggcagcaccggcgtttagtatgacaatgtcacgttgcggtccgtgcttgccagcgagaatattttgcgtgatttgggcattttcttcaggtgtcccaccgaccagatcggcgcgctgactgcgattgaagccgaattgttctggcgtcaccgtatattgggtgagctggccggcatttagttcaaccacagctgtttccgcggcggttgtcatttcgtcaaggccgtcacgaccatgaacaaccagtgcattggtgacgccgagctttttcaggacgttggctagcggctccagcaaagtttcatcgtagacaccaagcagttggcgcgttgggtgagccggattcgccagcggaccgagaatgttgaaaatagttcggaaaccaagctgttttctaacgggagcgacatacttcatcgacttgtgatattcctgcgcgaacagaaaagccaaattgttttcctgcaggctttgataactgacagccggcgtttcgttgatatccaagcccaaagcttcaagtacatcggcggcaccgctctttgatgaagctgcgcggttaccgtgcttggcaacaggcgtaccggtcgccgcaacgacaatggcactggtggtggaaatattaaaggtgttggcatgatcgccaccggttccgacaatttccaaaacatccttggtttccggaaaagcgagtgcgtgccgccgcatagaagctgccgcaccggcaatttcgtcaatcgtcggtcgcttagccgttagcgccgttagtagactagcagtttgcacttcagacgcctcgccattcataatttcatccaaaacagcttggctttcttcaaacgttaaatcttcgtggttgacgactttttcaatagcttgtttgatcatggcgatccctccaaatttggttgtgacagtggcttggttgttgagaaaaaaggctaagcgaaaatggccatcgtttgatttccttggtttgtttcatttttgggggacctcctttgatcgttgagatgagtggttgttgttgacgtgcttcttcataacgcgcttgcagtcgccataatgcgttcgccagcccagaaacctgcatgtaaggaccttaaccgcaatggccaaagaccggccatcacggttaaggccacttacactccggtttctgaccaggctggcttacgctcacaaaaaaatccgcccataactaaaaactagttaaggacggattttccgcggtgccaccttagtttgatcgctcgagtcttcgacaaatagtctaacttgattgtctaaaaaagagtccgattgatcacgcttagcgagggaccaacatccctccgacaactgacgtatgcctgacgtttccccgtactcgcaagctttcgggagaaccctccgtggtccatttaatcatctgcgttcgattgcactctcagcaacggcaactctctgtgcgcgcacaatgatcttgatctccacatcaacggtttttcatggacgaaatattaatgattgattcgtatattagagaatgttcataaaaatgtcaacacttttaatttacctgcgtgtattcggcaccggccagttttcctctgtttctgaaaatagtgagactcgcacagggacgatatcgttttaaatacttttagtacgcaactgccgccgatccgtccagagcgcaacaggggaaagacataagacaattagagcaccagcaagataagtgtgactaaacgcgcgtgacaactgggtatttttacggtgcgttattgattgaaaagttgtttgcagcgtttgcttctgtgcaatttgtttgatgccgtttaaaaaggcggtctggttcgtgttgatggtcgtggcaccggtggccagtttggtgacactcactgacagaggtgagtggctttgttgcatcattttcgttaaagcggttagcccagttgtgaccttgatattagcgtggcgtaacgcggaactggcatcatatagtcgccgcagatcagttcctgtcgcgggtttgggtagattggttttcacttttgctgcttgagctatgacttgtttcattttttgttgctgatgagttgtcggcgtggatgagccggcgaaaactttccttaattgctggtgggccacgcttttgacgtagggtgagagcactttttccgttacgatttgatcgctggcatggtgaatctgggtcttagctgtgtcgatattggtatccagcactgttaccagaacggcgatgcctaggcaggtgccgatttggcgggcagcgttgacgattccagagccgatgccgcttttgttttttggcaggtagcgaaccgaggcgaccaacgagaccgaagcgaagccaaaacccatcccgttgatgatgagcagtacaacgatgagtgcggtggcggtgtcggttttaatgagcgaaagcaggaagagactggctgccatcaccagcataccggtgagtgtgaccggaatcgcgccgactttggcaaacagtcgagtcgcaagcggcatggcaatcatgatggtcagtgaaacggggataatgatcaaagcagcgtgtaagggactatctcctaagacgtcttgcagaaaataattcaggattaagctcggtgcaactaaggcaaaaccggtcatgaagtaaatcacactggacgcactaagcgttttttcccggaaaagattgagctccagtaacggatgccgaaccattttttcagtcatgataaagacaatgagtgctatcccaccgccaattaaactggtcaaaatcagtggtgaagtccagccgtattggcgaccttccaacagcccaaacgtgatgccgccaagtgcagctgtcagtaacagtaaccccgggaaatcaatccggccggcaagtgattcatcatacgattcttttgcgcacacagtaaccagtaaaaatgcgagaatggctagcggaatattaatcccaaaaatccaccgccaagaagctatttgtaaaatgatgccaccaatgggcggtccgccggcagctgccagcgcagtaacagcaccgaccaacgcagcgacctgattgattttttcttttccgtagacttcgatgcccatcggtaacacgattggcgtgatgatggccccgccaagaccttgaaaaaagcggaatgtaatgagtacgggtagcgagggtgcggtcatgcaggcggcagagaagcctccaaacagagccagacccagtaacatgatttttttacgaccataacgatccgctattttggaagccgtaatcataaaaaccgacatggcaagtgtgtaaatcgtcatgacccaactggtgttcgcaagtgaaccgtgaagctcggtcataattttgggaatcgcaatattcacaatagtcgtgtccaacgtccccataaacatggcaatcgtcaggccaataaaacaaagtactttagtcaagcgcgtcattgcatcagatcctttcatctgctacatttgtgtatatgtgacacatgtgtgactttcgaaagcactttgagtatactggggctaaagataagcaacaagggtttggtgacaagtgctacaaattgatggtgtttgtgtcagttaggagacggagaacatgaacggaaaacaacgcatggcgcgccaatcaaaacaatggttagtggatgcattagtgacgttgatgaaggatgaggcgattgaagatatttcgattacggaaattgtccaaacagcggatttatcaagaagaaccttttatcgtgcgtttaaaaccaaggatgatttaatcgattatctgtgccgccaactagcagatgattatttcaaaagtttaaaagcggccacgcgtgatcaaactccgattagttttgccaccacgatgcaaaactttttcacattttggtggcaacaaaaagaccttgtccggttgttgattcgacaaggtctgttcgatcggttgaatggcgtctggcaacaaaatgcagtcgcgcattatcgtgactttccggcgccgtggcatccgcaaggtacggatcaagaggtcaactacatcatggcctttgcacttgggggactcaccaatattttgcggctttggctagtccaagcgcatccggaatccccagaagaaatccagcaatgggcacaagctagctttgcacaattagcgcggagtttgggtggtggtgaaaataacgcgcctcatgaagcttaagggcgatcgtgcggttaaaagaagaaattgataggtaaagttaaatcggcattactaaatacgagcacgccgtcagcagcttttcccttaggtacatcgagtatgagattgatcgtcttttcctcgctcgtgttgataacaggtaggtttgatggtgtttcaatggcaactttctgattattcgcggatgcggtgaagtgactcggtgaaaagctaagcggaatggcgtaatggttattatggaaagttagcgagatcccggttttattttcgggcatgtttggcaagtaggcggacttaatcgtgaataatagttgtttgttatgcccgtagtaagcaactttgcgaccgatcgcgacgggcttgctagtaatggcactgtgcggaatagggtatgtggatggaacagtgatgacttttttgcttgtgcgctggcgggaggttgtttttaaaactaattttgtcgatgtagcgtgaagctttttcagcgtcacggttttctttgttgccttaccactggctaatggctggttattcagatcttttagcgagtatttagtgttgggtttgacttgaaaagttaacttaagagcgtcatgaacagtggttacttgcactttggttgcttgtggcgattgcgtttgggcgtgcgctgcttgctgaggggcgaaaataccgatgcccaaaaggatggcgaatatagtggctgcttttttcacagtgatccctccaagtggcgtggatttatggtatgtggctaattatagttgaactttggctgtggatactatctttttctaataatatcataaatatttgggggggtttctgtgactgatatttgtctttaaaataactcaaaagtagccatcgcatttttagcaggtttgcaatggccgcttgcttgagttcttttgccaatgagggggagatataattcgctgtttcaaacaggttagtttttgaatcctaaatgggcaataatagttcatttggcgctgcttttggaatagttttggtcatacctctttgccctgtgaaggttcctccgacacgataccaagttgctccttcattgctttaaagtaatttctttgatcgcttcgtgtgccaaaggttgattcgctttgggtcgtattttagcgtaccatcttcaccaagaacacggtcattttgattttttgtgtccatgttgagaccctccttgtaaggacatatacacgagttgagatgttagtacaagtatgaaaggtgcacttaaagaagcaatttaagctaggcagcacaaattaatgaacagttatcaaaatgtgacacttaaacggctttggataaaataaaccacactgatccagccttttcaagccaagcgagcgtaatattttaggttaaatgtactgcataatctcacacttgaaaaactcaatactgcaaatgatctttagatatttatttgcgactcgccctgtcagcttgtcaattaatcaagccaaggacacaactttgaccgcatccattgcttgtaccgttctcggacgctggcgtggttagcaatctttcctgaacgtgcaatatagtcacaactgatcaagccagtcaaaatggtgtaaccacttatcttgcgaatagataactcgattctaaaagggggttttgattctcgttattcatcccagacgttccactaaaatgccattatcgtcgatgctttcttccatcattgctttacgtaaatcgtagtcggaattactttcgaagatactatgcttaacagacaacagactgatgacaccattttcggcaatgataggctaatattcaacatttttaccaatattaaatgacgcggaaactgtaatcatagttgaatttccctgacggcgctttttaacagtcatgtttatcgttctttcccatgccatgaccatctgtgcagtttttttgtatcaaggtgttagccgaattaaaacatatagttgctcttgtaagtaagagcggtttgcgctattaataccttaaaaagggagtggattgcttatgacattagaagttgttcctttttcatccgcatcatccgaaattgatgggttgaagattattcatgtgaagatggtgacggatgagcgcggaacggttcgagagttgtttcgccagagccagcattcgcaagtgttagtaaaccctaatatggcttggaaacaggtcaatttgacccggactaagcgcggggctgttagagggttgcatggtgaagcgatgtcgaagctcgtcacggttgcccatggagaagcatttggtgcctatgtggatacaagacgggacagtcctactttgggttccgttgtcacggttcgtttaacgccaggtgtgcaggtttttgttcctcaaggcgtttgcaatgggtttcaggcggttgccgatgatacggaatatctttacttcttcgacaacgaatggcaaaagggaatgaccggtgtggcactaacacctttggatcctgatttggggattgagtggccgatcgccattaagcctgataatttagcgcaaatttcaaaaaaagattccgaggcgcctactttgaaggaagtgctgaaacaactggcagagacgcggccaaaggaataactagcaaggatagcgactgccaacccggttacatagtttatcaagtgacaggtacaaaaatatgatcctgagacgtcttttgataaaacaaaacgcgctgacccagcttttttaaagttggacgtcagcgcgttctttttgtttacaggaaattttccaaacccacaaccaaatgattcgctgcctgaaccttgcgaatggcaacggcgactccttgcatgaagctttggcgatcgaaggagtcttggcagatggtgagggcttcaccgggaccgccgaagaggacttgttcgtgggcgatgtaacctggtaagcggacggcgtggaccgggacgtcatcaatgcgttggccgcgggcgtcgttgtcgatggtggacaagggcttttgggtgcgtccggcggcgattttgtgcgcagtggcgatggcggtgcctgatggagcgtcggccttatcctgatggtgcatttcgataatttcggcatcagggaagtaggcggcggcttcctgcgcgaacttcattaagagaaccgcggaaaggccgaagtttggggcgattagaccgccgagatgacgggcttgggcgagttcgattaagcggttttgatcggctggcgtcatgccgcttgtgccaacgaccgggtgaatgccggctttgatcgcggcttcaatgttggcagcgacggcagtggggttggtaaaatcaacccacacatcggcaatgtcgggattgagctgatcatagctcgtgagcacttttgtatcagctggtagtccatatttttgggcatcagcggcaattgctttcggatcaaaaacggcacttaatgcgaaatctttttgtgactgaaccattttgactgttttttgacccatggcaccgcgaaaaccggcgacaagaacgtgaatcatgcaagcacctccgcttcaattgctgatagttccggaacccctaatagatgggctaattcctgttgttgtgccgctgttaatggcagtaacggtaaacgcgggctgccgactttgaatcccaaagcattaagtgcggctttggtaggcgctggggatggaaaatggaataacgcggccattttcggtaacagttgccgttgtaatgcagctacagtggtgatgtcaccgcgatcgagcgcacgatacatttcccggatgctatgggcatataggtgggaggcaactgaaataacgcccatcccgcccagtgttttgatcgtcagcgcttgagcatcttcgccggtccagacattgaaggcatcgtgtttggttcggtcgatgatatcgctgagtgctgccagactgccgcactgcttgatcccttgaatcatggggttttgtgccagcgttgccacggtttccggtaacatgtttacgccggttcgccctggaatgttgtaaataatgatcggtttttgcgcacttgccgcaaccgtggtatagtgcgcgatcatgccatcttgatccggcttgttgtaatacggaaccacaaccaaagtagcatcaattccggcaattccaccgacttcatgcgtaaaatcagtggtttcgcgggtgttgttagaccctgaattggcaatgacgagtgcgcgcccgtgaaccatggccacaaaacgggtgtaaagggtgatcttttcatcatgactcaacgtaggcccttcacccgtcgtagctccaaccacaaacccgtcagtgccttgatcaatgagatgatcgactaaccgttgcatactatcatagtcaatttcatcgcggtcgttaaacggtgtcacaatcgcggtgattaattctgctctttgcatttaaaaaccccctgagcgcgagccggcgcgtttagaagtcggagtgtaagcggccttaagcgtgatggcccggtcttggccattgcgcttaaggtccttacacgcagacttctgcgccggggagcgcgttaaagtgagcgtgagccagcccggttagaaaccggagtgtaagtggccttagccgtgatggtcgggctttgaccattgcggctaaggtccttacacgcaggtttctgggctggcgaacgcgttatcgaaagcgtaagccgccttttatgccagcaaacgcgtcatgttgaatccaatcggcaagccatcaccaaaagatccgtgactgtccttgcacgctatcaatcaagatcctcagccgcttccgccatccgatgcgtcagaaaatgaatgatagccgtcacacctggcgctagagctgcttcatctggtgaaaagtcagcggcgtgcaactgcgaatccggatcattcacgcctagccaaaacatggtgccaggaattttgtttaatagataaccaaagtcctcaccggtcatgaccggatcggttggcacaaaggttacggctgggtcggcttgcatgaaatcaatgaaatcttttgtcagttgcggattattttcgacgggataataaccgccttgattcaaatcgactttgacttcgcagttgaaactagccgcgatgccttgaccgatatcccgaattcgctgttgtaagaaattaatttgcttttgcgtgaagccgcgcaaggtgccttctagatgggcgctgccggcaatcacgttgcggatggttccggcgcgcatgaggccgaatgtgatcacggcgctatcggtggggccgacattgcgagcgacaaccgtttggatttggctgatgaaactggccgttgcgacgatcatatcgttagcattttgcggtagcgctgcatgaccgcttttaccgattagatcaacgttaatctcagtggtgccggcaaaaagcgttccgagccgcgtgttaatcgtaccagcaggcaggtcaggccgatcatgcaggccataaaattcatcaatctgccactcaccggtgaaagcgcccatgtcataagccagtttaccgccattcttgctttcttcagccggctggaagaagaaaatcagatgatcctttggctgatgaacggcaaaataactgagaacgccaagtgccacggtcatatgcatgtcgtgaccacatgcatgcgcaatcccctgatgatgcgaggcaaacggcaaaccggttgcttcggtgaccggtaacgcatccatatcggcgcgataaccgattgtgcgttgcggatcggagccagtgactttgactagaatggcggttggtaacttcggtaaggtacgaatggtaagaaaagtctgcggaaaactttggatggttttgagcaggaaggcatgggtttctttttcctgcagcgctaattccgggatttggtggagctggcggcgaatagcaatgagttcggcttccttcattaaatgtcacaactttctgagttcatcaagcagcaccgtcttagcttcggtttgatcgttgacttttttaatcaccttggctgggacaccggcgacgactgtatgggcaggaacatcattaatgacaacagcgcccgcagcaatgacagccccttcgcccacggtcacgccttcaagcacaacggcattggcaccggtcatcacgtgatcaccgattgtcaccggcttagctgacggcggttccaccacgccggcaagcactgtgcccgcgccgatatggcaatgtttgccgacaatggcgcggccgccaagcacggcccccatgtcaatcatggttccggcaccaatttccgcgccgatgttaataatcgcgcccatcatgatcaccgcgttgtcaccaatcagcacctgatcgcgaatgatcgcaccaggctcgatacgggcattggttgttttgatgtccaataatggcaccccggtgttacgaccggcagcctcgacatagtaatcatccagtttagcggtttttaaaacgggctgaatctctgcccagtcaccgatgacagtgccggtgtgtttgccaataaatgcatggacacttttaggaaaatgcaagtcggctaatttgcctttgagatacactttgaccggcgtggttttcttgctgtttgcgatggttgaaatgattttttcggtattgagttgtgccatgatggcctcctatttttttgcggcagtagtggcggttgatgtcggcgctggttgacttggagcggtgtagtgctgatcgtgttgaatcaaatcggcgtaagtttcacgcgtgaccaccaactgtgcctggccatcttcgacaaaaacaacggctggacgcgggttgcgattgtagttggacgccatcgagtagccatatgcgccagtgtcgaaaacggcaaccacatcgcctggctgtgtggctggcagcggggcatcgtcaatcaaaatgtcgccggattcacaatactttccgactaaatggacatgttctgtgggctgggcagtcgggtgatccgcaaccacagcggtgtattgagcctgataaagggcagggcggatattgtcgcccatgccgccatcaaccgcaacataaggccgcaagcccgggacatctttgcgactgccgaccgtatacagactgtagccggcaggaccgacaatcgaacggcccggctcaatccaaacggcaggcaatggccagttgaaaccgtggctttgggttttcagggtggtcacaatcgcctgcacaaaagcttctggtggtagtggatcatcctgcttggtatacgcaatcccaaaaccgccgccgacattgaggactttaggggtgaagctgaattgctggtgccaatgatcaaggactgccagcagcttttgggtgacggcttcaaacccggcgacttcaaaaatctgggagccaatgtgggcgtgaatacccagcaaattaagatgatcatccgccagaatacgcttggctgcttcatcggcttgcccgctttcaagatcaaagccaaatttactatcggtttggccggtttggtcataagcgtgtgtatgagcactaatccccggtgccacccggatcaagacgttttgcttgcccacggccgcctttagcaactcgtcaagcaggtccaattcatgaaaattatcaacgatgatcgtgccaaccccggcgtctaaagcttgttccagttcggctttgcttttgttattaccgtggaagctgaccttttccatggggaagtccgctgcttgagccgtgtataactcgccaccggaaacaacatcgacatgaatggcttcggctttggcgacctcatacatcgcgatggtagcaaacgccttggaagcgtaactaacggcgtatgcgactcccgccgtttcaaaaacctgcttgaacgcccgaatctgatggcgaatggcgccaacgtcataaacataaagcggcgtttgaaaagtgtgggcaagttgactggcagcaatcccgccaatcgttaattgaccttcgtgatttgtggcaaaattcattcagttcatcctcccgagtgatggcagggcaacggcaaacgaaaagggacccttttgtttggccgcgcgtcaaacaaaaagatcccaacttgcaatctacttgaatgatagcgccccgcttagatacctaagcgacagtacaggatttattcaatcctggcccaacaggctcaccgatcccggatcacccatttcggcaaccgcccctttcaccgaatgtcaccacgaaggatctcgctcgattcggttagtcatgttggctgcaacctctatctgtttaacaccacattataataaaaaacggtacgcgtcaaatttttgtgagcgcgagccggcgcggttagggaccggagtgtaagtggccttggtcgcaatggcccgggtctggccattgcgaccaaggtccttacatgcaggtccctgcgccggggagcgcgttatgggcgtaaaagcggacttgtggcctcaggcgtaatggcccgggcttggtcattgcgcccaaggtccttacatgcaggtccctgcgccggggagcgcgttatgggcgtaaaagcggacttgtggcctcaggcgtaatggcccgggcttggtcattgcgcccaaggtccttacacgcagactcctgcgctggggagcgcgttatgggagtaaaagcgaactagtgcccttagacggtgatggcccgctcttggccattgcgcttaaggtccttacacgcagacttctgcgccggggagcgcgttatggtgagcgagagtaccttgctcagagaccaaatataagagcctcaaacatggtggctgacgcttactttctatttcttcagcgcgaacagtgtgactgtatgccaaagaaccatcttgacagcctgattcccaacaacccactttcaatccgtcaccccaatacctagcaaaaaattaaaaacatttttaagctcattattactatgcaatggcgtcaaaaaatgctgttttggcgggatggtgggggcttgtgtttctctgggagtctgttaaagtacagaataaaatgacagagttctcatttgcattgccgtctgttgatgccagatgaaaatcacttacgcaatcgctgtcggttggtgattggcaaggttgttggcgtcaaggatacactggaaaatggggttagggaggcagtttatcgtgcgtgtcgtaaaatttggcggttcgtcattagcagatggagcgcagtttgccaaggttgtggcgattatgaaggcgaatcctgcccggcaggttatcgtaaccagtgcgcctggtaaacggcatcccggcgatgtcaaggtgacagacctgctaatcaagtacgcccaagcggtgttgcagcagggtgaaacggctgcaatcgttgctgaaattgtggctcggtatcaggccattgccacggcgttcaaccttgacgcgcaagttgtggaaaaaatcgaaaacgaactataccagttaccgaataccagctttaaaaatgccgactacctaatggctggcttcaaggcacgaggcgaaaaattaaatgcttttctcatgacggcggtgttgaatcacgaaggtatcgaagccacgtatggtgaaccgaaaacattaggaattgttgtaacggatcatcccaatgacgctgaggtttcacgtgaaacttacgatcgtttggcggcatttcggcggccgcttggtgtgctggtagtaccgggattttatggctataccagtcacggcgatattgctactttttcacgtggcggctcggatattaccggtgcgattttagcaaacgggtttcatgccgacctgtatgaaaatttcactgatgttgatggcgttgcggctgctgatccacgggtggtggcaaatccgcagatgattcaagaaatgacgtatcgggaaatgcgggagttatcatatggcggctttggcgtttttcatgatgaagcgattctaccggccattgcgggacagattccgattaatttaaaaaatacgaatcatccttctgcccctgggacgatgattgtcccggaacaacattttgtgccgaaacatgcgattaccggcattgtcagctcgcaacattttggggcgatctatctgcatcgttatttactcaataaggaagtcggatttacgctcaagctgctgcaggttttggcgcgacatggcatcagttatgagcatatgccaagcgggattgacgatttgaccattattttggacgatcggcagctcacagaggcgaagcgtaaggccatttgtgctgaaattcaggaagttgtacacccggacgttttgaagtggattgacgattatgcgattatcatggtggtcggtgaagggatggcacaaagaaccggattgattcagacgattttgcagccgctagcgagtgccggggtgcatgtgtcaatgattaatgaaggggcctcccagatttcactgatgcttggcacatcgcgggaatcggcgaatcgggcagtcaaggccatctataacgcctttttcattccgatcaatcagcgcttggaggtgcagtgagtatggtgacattacaaaaagttcatggctctgaaaatagtttctttttattagatgaaacgcaattgaaacagccattgaccacaagccaactggcagcttttaccaagcaggtgacgaatcgccaaactggctggttaggcggagcggatggcgttttggcaataacggatgcgcccgggactgctggaaaaatgacggtggtgaatactgacggcagcctggctaaattgtgtggcaatggtttacggacagttgcccgctatctaagtgaaaaaaccggtcaatcagcattcaaggtgcatacggattttgccgacttggccgttgcaaaacagtcgccattagcttccggcgttccggcatattcagttgaaatttcgccagtcagttttgccgccgctgacttgccatttgccaatcttggcgttgaccgcatcgttgacactgtcttgccggctattcatcctagtttgaagtttaccgcggtggcagtacccaacccgcacttaattgcatttgtgtctaaagaagaactggccagtcctgatctggagcgaattggtaaaatgttaaatgccaaaaatccgtattttccggaaggggttaacgtaacgtttgccgaaatcttaggtaaggacaccttgtttgcccggacttatgagcgcggcgtcgggtttaccaatgcatgtggcaccgggatgtccgcaacgaccttagcgtttattctgactcatccccaggaggcggcatttgaacgcgtgaataccgtgtataatccaggcggcatggtgaagacgatggttcatcatgatcacgagcgttactggatcgaactcatcgggaacgcaaccgtgacggcgacaatcaccgtaccggatgaagcgcttgaaagtggtaaactgacacaagcaactttccaacccactggcgagcaggcggcttatgagcagttcattgactcattgccgcatcgagatttggcagacacattaatagaaggagcataaatcaatcatgagtggttatcacgtagcagttgtaggggcaaccggcgcggtcggaacccggatgttgaagatggtcgcagaaagcaagctgccaattgcgtcagtccttgccttggccagcaaacggtcagaaggtaaaacggtaccttttcgtgacgggacgttaacggttcatgaaacaactgatgatgcgttcaaggggattgatattgcattattctcagcaggcggctcggtttccaaacgatttgcccctgcagctgttaaagccggcgcggtggtcgttgataacaccagtgcttttcgtatggaacccgatattccgctggttgtacccgaagtcaatccggaagccctgcgcacccaccacggcatcattgcgaatccgaactgttcgacgattcaaatggtgaccgcacttgagccaattcgcaaagcattcggcctgaaacaagttgtcgtttcaacctatcaggcagtttccggcgccggacagtcagccatgaatgaattgtttgatgaaacccaggctgccttggacgataagccattggagcctaaaattctaccaactgctagcgacaaaaagcactatccgattgctttcaacgccttgcctcaaatcgatgtcttcgaaccagacggctatagtcatgaagagtggaaaatgattcacgaaaccaaaaagattatggctggcgacatgaacagtgatgcgatcaaagtcaccgccacttgtgttcggattccagtgccaattgcccattccgaagaagtttattttgaaattgaagacgctaacgccaccgccgacgacattcgcgctgcattaaacgatgcgcctggcgttgtggtgcaagatgatccaagtcaacagctctatccgcaagctatgaatgcagtcggcagcaaagaggtcttcgttggccgtattcgcccggatgctgaaaatcctcggttcttccacatgtgggatgtttccgacaaccttcttaaaggagcggcatggaactccatgcaaattgccgaaacgatggatgccatggggttaattcaaccgaaataacgaataagtttaataaagccatttgcgtagtgcacgtcaaaacactaggcaaacggctttttgttttgcagcggggggacaacagacgtaacatgccagcgtcctctgtaaataacgcctctaattcttgctagaagcttaagatgctgccaaattgattgacggatttcttaaaataactatactgatgaaaaacgagtataggagcatgttacatgaaaaagcatcgtttcgtcatcgcattgatcggcttatcactttttgcagtcagcagcactgttgccgccgatatgacgcaagccaatatcgatcagcaggttgtccaatacacgttgaatggcaaggggctggtcattttcaatcatgcgcgcacttatcgcacgaaaagcacagccgcagtttatcaaggctcctttgctgcagatgcaccgacagcaagctttaaaaaggtcggcaacctgaccaatcataaagattatcgagtaacgcgtaagataacagccaaggctaagttgaaaggatcggccacgcagactttttactatgtgtccgggcacggttgggtgaaaggcagcgacttgacgcgatcgtgaactgtgtcttcaatttcagggaaatccgtgtagcaacgcagctaagattgcgtgaatctgtacggatttttctttttgactaaaattggtaaagttcgatcttgacaacctgtatctgctattctatcttgaaaacaatataaagcacgttaaccatttattattggcgatattgagtgataactaacaatgacggttcatggtgaggactttacggaggcgagcagcacatgccaataggcgaacaaattaaagatagacgcgaagcattagcgtggagtagagaagaattggctcaagtggtcaatgggtcggtacagcaggtctcaagatgggagaagggcatcagttatcctaatatcaagcaactgattgcgattagcgacaggttagagctcagtttggataacttgatcaaaagcgatcccaaattgcaaaagacaattcaaattgataagaatgccaaggaagctagtgattatctgcggatctctcttatttttagctttacatatatgatcttatttagctttgctgctctctttatgtaatagcgaacgtaagtgttgtcaacatcagctgtttatatcaatagtgatgtgttttactcaaataatacctcaccttgatttcgatgaggcgttgcaatgctcgggatgatttgatgacctttttgtggcaggtaccgattgtactgtatggcattgtacttggctgataaacataccttgtcctgtatgggatgaggttttttcatttgcagtagaattaacttcaattcgatcaaaaagccatcatgaacctgaatataaaaatcgttgacctgcctgactgtgaacgatacaatcaaactccgacttttaaaaatgaagaggtgatttgatatggtaaacgtttactttggcccaatcccgcagaggccagattcggtgctggtgttgcagttttatcatggcagactcatttgggtacataatgtgaaacggaaatgggagctgaccggtggtaaattggagccaggcgagacggttattcaggcggcggttcgtgagtcttacgaagaatccggcgcaatcgtcgaacccagtgcgatttcgtcgttgggctactatgttttgccaaccggccatgtaacggcagttgttcaagcagaggttttacgtttagaggcgatcccgacgacttctgaaaccgatgatcgccgcttactttttaaaccggtaccggatccggaacaatcttttcatgatcatatttatcggcagatttttcagcacattgggtggccccatgagtaagcggcgcgtgggcttgttactgaatcttttgtcagtggcagtgatggcagtgacaccggtgatgaacaaatggtcgatgaacaccctgtcgccgctagctgcaagtttttataacgcgcttgtttcactcgttttgacttttatcacgattggcgcaactcatacaaaattggtatgggtgaaaagccccgttatttgggtattaggactgaccaactgtttaggcattgttttgcagtatttgagtcttttctttcttgatccggtgagtgtcggattgattggccgcttctatattgtttttgcaattttattgtctgtattcttgttgcatgagcggtttgatcgccgagaaatagtgccgattgggttatgtattgccggaacagcgttggtatccgatttctccgggcgtatgactgacatgctcggactggtttgtgcgtttggctacacgtttagttttgcgttaaccaacacgctggcgaaaaaggcattggcgcgcgtcgatgaaaaaattttacttttgtacaaccaagcaaccgcagtgatcatactcggcattgttgcagccggcagtggcaagttagctttttcgcccagtatgggtattggtgccgttgcagtctcggctttttgctccggatttctgggtctgctgctgttttaccgcgggcttaagtttatctcatttcgcgatgccaatttaattcgcgcactaaacccagtatttgttctcgtatactcattaccttttttccgaattcaaatgacgccagcgtttatactcggcggcggattgattatcctatcaattgtctggatgcctttgccggtgaaaaaacgtccggcgattgggaaggaaaactgacagtgaggccgctattttttgaagtcatttttgctaggattttctgaaaattaacgttaaattgggaaaacacgacgtttatttggacgatgccacaacttcatagaattattttacactagggatagtaagggaaaaaggtacctaaaaagcagtttaacagagccagcggttgttgaaccgactagtcgtcttggaagaaaagacaggctcgatcttgaagaagtttaagttggaaacaacaaaaatatatctttattattatgcttgtcagcaggtaactcgatcggtccgtctcacagtatggttgggttaggtgtcacgttttttggaggtgaatacttatcgttgatttaagggaagacatcatcgctacttgcgtctttacggtatttctattttgcgttgatttaatcctaaaggctccgctgcagattattagaaatctgttcactgggctgcttttctttgtgattatgttactagttcaatatttatgccgtaaaaaaacatgatgttcatgaggagtctcgagggggtgactgaacgatggtttcaaaaatcacttgtctcacaacgaagcgttaacgtgaaatcttacgttgtcggatactaatcgttgataatatcttttgttagatttaatatcaccccaaagttcagcgttgcgttcattgcttagatcaatgattgaataaggttgttttgcaaaggggattgatttgaagaaaaccaaataatgtttatacgtgaaggcaatgctgtatgcagcggccttcttttttcgagggtaggaatgaacgtaactgatttttgcgtttgggtatttctttttaagtttcctcaattgcctttttgttggtctatgggtaagaactaaatgacgttgcggttttaaaaagggaactcttagacggagaacttgaggaaaatctagtttaattactttttcaatattgtattgtgtccgtaactttgcaagctttttgtttttgggagaagacaaaaaaagaatttgtttagaagaataaccagggtatccatataagaatattccgataatggttaataccaagatgggggagaaaataagcacgaggaagaatacaaagtacaaaatgtctgacaggcttgcaaacatatctcgccaaattagttctcccagtaacattaaacttgcgtagattccaacaacaactctgacaactaatatgattcttttttcaaagggaattgtcgttagcaaaaccatagattggtgaatgatgccaatgtaatccttgaaagaaatatttgagacaaacaatactagctcccccctttttaaacggaaatgattctccttatcgaatatatgacaatctagatttaattaattgaatagtcgcatcttcgactattcagatgatttgtcctgaaatcgctacgccgtaaaagaagtacagtctaaggttgatgtaactcaagttaagtgaattctaacatgaaatcgtcatttcagtacattcaagaatgtacagagtaagactaataaaaattgcctgtcacgaacggataagttctcctaaaccctttgaaaacgggaaaagtcagctattaaagcgtcaaggcccaaatgaatcagttcctgcgtgctcttttacgtccttgctgccagaatccgcttgcacagtatggtagaatagctaaagaaatccttaagtatctgcgcgaagtgaaagcgagtttttctatatgaagaaattgtttgaacggatccgtatgcctgagttcctggaagacatgcggatgcggtatgcagcgattgcgatggttgttttggcagtcatcggtattttaattggcgcgttgattcggccttggttggctttgttgatgctgctgattttgatcagtctggtggcgacgattttttatgcccttgagacgattgccaagaatacgaatcagtatatttcagatctcagttatcggattaagcgcggggaacaagaagcgctgattaaaatgccgattgggatcatgatttatgatgaagacttgaatatcgagtggacaaatccgtttctgcagaagtattttggcgatacggatgtgcttgggcagccgctggaaaaagtcgatgctgaattggcagaactcattcgcagccatgaagacaccaacgaaaccaagatggtgacatggggccagcatcagttcgagattattgtccaaaagagcattggcgttgtttatctgatggatatcacgcgttatgccgagattgaggagcgggccgaagacgagaagatcgcgattggccagattttcattgataactatgatgaaatcacccagacgatggatgatcaggttgtcaccaacttgaatagttacgtgacgaatcaactgacagattgggccaatcagtttggcatgttcttaaagcggattgacaacgatcgctttttcttactggcttatgccaaatcattacgtgatgtcgaacgggataagtttaagatcttggacgtgattcgggaagaaacctcgaagcagaattatccattgacgctatctgtcgggattgcatatggcgatgaagatttggcacaattggccgtcacgtcgcaaagcaacctggacttggcgctgggccgcggtggcgatcaggtcgttgtgcgggcaaaaggacacgaggcgcgcttctatggtggcaagaccaacccgatggagaagcggacgcgggtacgtgcccggatggtggcgcaggccttgcaagagctgtttaagcaaacggataaagtcttcgtggttggccacaaacggccggatatggatgcggttggagcagccatggggattcgccggattgcccagatgaatggcaaggagtgttacattgtcattgacccagatcacctgcattccgatgtcgaacgcttaatgggtcaggttggtcaggatccggaagttgctaacgccattgtgacgccggaagcagcattgtcacaggctaccgatcagagtttgttgattctggttgatcatagcaagccatcgatttcagccgcgcctgatttgtacaaacgtctggctgcccgcaccgtgattatcgatcatcatcgacgcggtgaggaatttccggacaatccaatgttggtttacatcgaaccgtatgcaagctcgacttgtgagctgattgcggaaatgtttgaatatcagccaaccaatgtgccgagtcttgataagcttgaagcgacagcgatgttggccgggattacggttgacactaagtcgtttagcttacgcaccggaacccgtacatttgatgccgccagttatctgcgctccatgggggcagacgggatgctggctcagaacctgctgaaagaaaatatcgacagcttcattcagcgcaaccatttgattgatacaattgaaatgattgccccaaatatggcactatgtactggggaagaggacaagcgttacgatccggttattgcggcacaagcggctgatacgatgctgtcactaaatggtgtcgatgccagttttgtcatcaccaaacggccaagcggcgatgtcggcatctctgctcgctccactggggatgtcaatgtacaggttatcatggaagctatgggcggcggtggtcatttgagcaacgccgcaacacagatcaaaggcaaaaccatcgccgaaacgcggaccgaattgcttgcccagattaagaaagcagacgaagacgcatagaaagcagggattagtgatgaaagtcatctttacacaagacgttcgtggcaaaggcaatcgcggtcaggtgaaagaagtgcctgacgggtatgccgagaactttttgattcgcaagggtttagccaaggcggcaactccgcaagccatgagcgccttgcgtggccagcagcggcttgaagaaaagaaagaagccgagaagaaggccgaagctgaagcaattaaagccaagatcgaagacgacaagacagttgttcagatccaaagcaaggccggtgaggattcccgattgttcggttccattcctagcaagcaaatcgcaaccgctttggacaagcagtatcagatcaaggtcgataagcgcaaaatcgacctgaagcagccaattcgttcgctaggattcaccaatgtgatggtcaacctatttcctggcatcgatgcgcgaattcgcgtgcatgtgattgaacagaaataatttgtagcaagaaagggactgcttcggcggttctttttttgtgagcgcgagctggcgcggttagggaccggagtgtaagtggccttggtcgtgatggccgggttttggccattgcgaccaaggtccttacactccggtccctgcgccggggagcgcgttatggagaagtgcgagttggcccggttagaaaccggagtgtaagcgacctcaggcgttatggtttgcgcctgaggtcctttccttacacgcggacacccgcgccggagaacgcgtcagatgaccgctaccaatgtatcaatatatgatgagcgatacagatgtgcaaacgcttgtttcggtcagcattttaacgtagactgttagggataagcggttaaaaatgagccgattaaattgaaggaggacgcgcatggataaccagttaattgaacagcagccgccgcatagtgatgaagcggaacgtgccgtccttggcggtatttttctgaatgccgacacattgccggatgcccaggaatacgtgacggcagatgacttctacaaaaagtcgcatcggctgttatttcaggcgatgacggatttacaggataatggcaccgcgattgatacggtcacggtgacggattatctggacaatcacaatcaattggatgacattggcggagctggctacattaccgacttggtggcatcaacgccgattgccagcaatgttgtgtattatgctaaaattgtgcagcaaaaaagcaccttgcgtaagctcattagcaccgcacaaagcattgccagccgcagttatacggaacaagacgatgttgaagggctagttgaagacgccgagtgccagatcatggacgtctccgagaatcgtaatcaggcagggttcaagcagattaaagatgttttgaatcaggcgatggcgcagatcgatcagctctatcaaaacgaccaaaccatcacaggcttgccaactggttttcgcgacttggacaagattacaaccggcctgcatgaagacgaaatgattattctggcggcacgtccggctgtcgggaaaaccgcctttgcgttaaacattgcccaaaatgtcgggacgaaaacggacaagagtgtggccattttcagtttggaaatgggggctgaacaactggtcaaccggatgttgtgttcggaaggcagcattgacgccaatcatttgcgaaccggccaactgaatgaagaagaatggcagaacctgattattgcaatggggagtctgagcaaggccaagatttatatggatgacaccccggggatccggatggccgagattcgtgctaagtgccggcgactagcccgggaacaaggcgacttgggactcatcatcattgactacttgcagctgattgaaggctccggccaagaaaatcgtcaacaggaagtcagcgcggtttcacgacagcttaagaaactggccaaagaattacatgtgcccgttatcgctctatcgcagttgagtcgtggtgtggaacagcggcaagacaagcgcccggttctgagcgatattcgtgaatccggctccatcgaacaggatgccgatattgtcgcgttcctataccgtgacgattattatcgcgatgcagaaggcgatgacgacgacgatcaagacagcggcgatgagggtgatgacaatgttggtgaagttgaagtcatcattgagaagaaccgttctggtccgcgggggacggttaaactgctatttgtgaaatcgtacaataaattcacaaatatcgcctataatggcccggatcagtaaattgtatttagaagattggacaaacaacgaccattgacgaacaagaaagtgagggatgccgcatggatgccattttaatgagtttaatgacagcactcaatgaacacctgctgatcaacgtttaccagcgtgataccgatgatttttacactggatatgtgcaggtactgggtcacgatgcggttgttctgggaacttataacgattcagggattgcggatggctgtgctttgattgccttttcagcgattgatcaggtggaatttgccggggatgatctcgacaacatgaattttcggattgacttggcacagtcggagcattttttgacacttcaagggaaagaaacgccgtacaagtttgacgccaccaagagtttgatctggcaattggcgcagcaggcaaaagcaagcgggcagatgatcatggtggttgttgctgacgatgacgcttatctcgagggccgggtcaccgcggtggcagatgatcgctttagtatggcgattttcaacaagtttaactatacggatgtccgtgccttgcaagtcgacttttccgatattttagtgatggaatttcacggcttggatttgaagctggaaaccgagctagtccgcaagcgcgatcaactacaccacgtcccgaccaagctgtatcaaaacgacggtcaacttgaaggggtgtttcagaatgctttggcagagaatcggttgatctcggtggtgccaaaagggcctgaggatcagttcttcgtcgggcgcgtcaaagcggttaatgagcatgtggttgtcctcagcctcaaggatatggcgggccagtttggcggctacattctgatgaccctaccaagtattcaaaatgtggccaccgcatcggattatttgcagacgatcggcttttacgagcagtgggaccaaacccatcatttcagccagcagccagtgttaaatgctgatcgggaattcgaccctaacgataatctggttaaggcgatcatctccgaggcagccgggtttgaacgggtggtacgcatcaaggttgcggatagtgatgagcattttctgggctatccggaacacgttgacgaaaccgacttcgacttgaatctggttggcccagacagcggtgaaacggttcgcattcgttacggacagattcgtgagattgcattcgggcatatttttgcttatctgcaagaggcacagttgaaaaatgctgaccgttaatggcagtttgttaacggtacggatgttggtggtttgaatatcggtgtggggcaatcaaaaaagcatggttttcacggttaaagtgaaaatcatgctttttatttgctaccgatttgcaccactatttgctagtaacggtaagaacatcatcgcccgctgtggtggtccgcggggtgaagtcggttaatgatgcgacgtgatccatgttggtaatgatggtcatcaccgttgtctttttgcccgcggcttgaacagcggctaagtccatggtggcgattggctgaccggctgtgaccgtgtcttgatccttaacgctgaaggtgaacggtgcgccgttgagttcaacggtgtctaggcccatgtgaaccagaatttccaagccggttgcggttgtcatggtccacgcgtgcttggatggcatcacactaacgatggtgccggatactggggcgacaatcgtcccggatgtcggttcaactgcgaagccatcaccgaccattttttgagaaaaaacgtcatcttcaacggcggaaagtgtttctaattgaccggtggccggtgcgacaaattcggtggtgccagattgagtggtaacaggggttgcagttggttggttgaccggttcaggttgcggggtagctgtttcgatgaccgtgccgtcagctgtggttgcgaccatcgcactcttaggaaccccgaagaagtaggtggcgatgaatccgcccacgtatgaagctaaaaggccaaagacataacccagccactggtggttagcgatcaacgggataagcgctgctccggatggcccgatggtgatcgcaccgacattgccaaacagtccgatgaccgcaccgccaatgccgccgcccacacaagcggtgataaatggccgtccaagtggcagactgaccccgtaaataagcggttcgccaacgccgagaattccgactggcaaggcacctttaatcaaacgggttagttgcttatttttgcggcacttgatccacaaggctaacgcagcaccgacttggccgccgcctgccattgccagaatcggcagcaaggcggtaaacccgagatttttgatcatttctaaatggatcggcgtgagaatctggtgtaatcccaacatgaccattggcaagaaggcaaggcccaaaacaaatcctgagaacggaccgccgacttgaagaatccagttgatcgagccgaccagtgacgttgaaagccagccggcaaatggcataatcaggaaaatcgtcagcaccccgatggacagcagactcagcatcggcgtgaaaataatatcgatggcatcaggaatgaagcgatgcagttgcttttcaaccagtgaaagcagccaaactgcgaagataacgccgatgatgccgccttggccagctgctagcggttggtgggtgaagatgttggtgatggtcacgggcgcaacaacccctggcaggtaaatcagtccgccgacaatcccgccaagcccggctgtggcgccaaattccgttgcggcattgattccgacataaatattcaagaaagtgaaaagaccgccgttgataacttttaataccgtgatgaattcggtccaacttttcggtagatcaccagcagccatcatgttgaccagaatgccggcaaccccggaaattaaaccagcgccgacaaatgccgggattaacggaatgaaaatggcggagatgtgcttcaaagcggctcgccaccacgtttgtttcagtgcggctttgtgagcggcatgaacttcggcggccttggcttcaaccgcagacttgttatcttgatggtcattgccaaccgaagcacttcccggaaaaggatcacctaagccaacgccgacttttgcgaccatggcctgcgcgactttattaacggttcccgggccgacaatgacttgtaaggtttcttcctgaacgacaccaaggacgccgggaacttttttcaagcctgcgacattgaccttggcttcgtctttaatggtcatccgaactcgggtcatgcagtggattaattttgcgacgttttgtgggccacccacctgtgcgtagatgccgtcccccattgcttgatacttatcttgccccatcttctgtttcctcctgacttaacgcaacggctttactaatgaagccatttgcttgattgagtaatgtttgtgcggtggtgctaggttgattcgttaagatcatgacgatggctaatttgacatggcgattcgccgcttcaaaggctgtttgtgcggttttggcatcgcatccggttgcctgctgaataatgcgctgactgcggacaaccagtttttcgttggtgggctgaacatcgaccataagattcttatagactttgccgatgcccaccatcgcaccggttgacagcatgttcaaaaccagtttctgcgcggtgccagccttcaagcgggtggaaccggttaagacttccggaccggctggcacctcgatggcaatctgagcatgctggctgatcgcggcgttatggttgcaggctaggctgacagtagcggcgccgatggattgcgcatagtctagcccgccaatgacatacggcgtccggccactggcggcaatgccaacgaccgtatcgtttttagttaattgacgttcttttagatcagactggccaagcgcaaccgaatcctccgcgccttcaacggcaacggtcatcgccttcataccgccagcaatcagtccttgaaccatttctggagcggtgccaaaagtcgggacacattcagccgcgtccaataccccaagacgtccgctagttccggcaccgatatagaaaagccggccaccgcgtttgaaagaagtcgtgatcgtttcaattgcggcctcaatcgcaggtaaagcatggctaacactctgcgcaacggtttgatcttcggcattcatgaccgtgacaaaatcatgaacactcatggtatcaagttgcatcgtcttttcattacgggtttcagtggtcatttggtctaagttaatggtcgtcatgttaaggtcctctttctttgtgagcgcgagccagcgcacatcatgatattttgaatcgaatcgcctgatgcggtccgatttgatcaagtaacggtaaattagatggttcaattttgccaatcacattcacccgtggatcggctggtaagtcgcagcgcgtcagctgaagctcaccggcatagcgaccatacgcgctattatcaagcgtgatgctgccgcggggacggggatcggtttgtgccggttgtggcgtggcaaaaatgtgttccagccgagcctcggccaagcgcacgactttttgcgcgatgtccgggcggctatgccatgttaggtggagcaggcgttcatcgtcagtctgcacctggattaaaagtacctggtcgtggacatatgcctgaaacgcggcaatactacgcgggctgagttgcggatcgccgacataaacatggtcgatcgccagttgcctgagttccagataggcagcaagcggaagtaagccacggtgagcttcaagtgttggtaaaccagcgaataaaggtccgcgttgttgcgcatcgccggaaataaatgccatggttttaaacccaagtgcgtgcagccatttatttttttgcgcaaaccatgccggatccagtccggtttccggtcgtggataaaagttgtgccaggcttcgatatggcgcagattggccttagcgttggcaagctgatcaatcatgcaagcggaaagtgtgctggcattgagcgcaatcgccatggtgtgtgacaacgcggctaccgtggtcatgtcaatgccgtcatcaatccgcaaaccgtctaatcccaacgcttgaattgcttttccgtcgtgcagtgcgatgcccaagcgttgcaaacttgcagcagagacatctgccataattgtcagtccgagttgatgacaattggcaaccaattgatccaaacgctggcggatgatttccggtttggcttcggataattgcaatgaggtaaagaccccagtgaatccggcttgctgcatctgtttcagataagcggcttgctgttcggttgccgaatcatttaaatagcaggaaaacccgatcatctcaattcctccatcaagaaacgcccgtagaagccgttagtggtttgcgggcaagtgtcgatcaatagcgaaaatctgaaagccctttcgtgaacttagcgtacatgatctttgatgatatttcaacatatttctaaattatttgaaataaagtttcaaaagggagtaaaaaataacgcaccgttggccggtacgtaaaggcatgatcatttgaaaccgtgccgcatgaattctttatacgctgtgactgccgccttggaatcatcggtttgcttcttagcggcatcgtagtaacggctaacgtaagcgtaatataaaatatcaattaacataaactgggcatggagggattgcgtcgcggcaaaacgattgggcgcctccatcggctgtgacgtttgaatcacgatatcggcataatgggtgagggcgttactgccaagtttggtcgtggcgattaccggtaaaccggctttcttagctaatttggcccctaagacagcctcgggtgattcgccggaattggagatgaaccacgtgagcgtatgcttcggatcggcagtggccgcgactggcaggaaaaggtttaaatcatcgctaaagtggcaagcataacccagccggctccatttctgagcgatgttttgtacggatagataagaagcaccaacgccgaatagcaggatttggcgactacggtgaatcaaatcaataatagtttgaaccgtgttttcgttaatctgatcaactgtttcggctaaagagcgggatgcattggttttcaacttggctttgatcgtcgtcaggctttcatttttttgaatttcctgatgatcgatttcaccgacttcgccattcaaatcggcggctaattgcatttttaattcgttatagccgttaaattgcaaacgctgggctgctcgactgacagtggccgggcttgttccggcggctttggccaattcataaacactcatggtcaacacgtcttgcgtatggtttaaaacatagtcgacaattttcttttccgcttccgaaagttctccgcgggtactttggtagttgccttcaacactcatgctagcctccttgaatcatcatcatagtgttgccgatcacttaggccggcaaaccattatggcatgaataaacggtgctgccaatggacgcggcgttaatgaacggttatttttccagcgccaataattggtacggcgatagaaagcgggttttcatcaaaatatcgacaatttctgcttccgagcgcgggttcgtttcatttaaccacaattggataatatcaatgatgccatacacgatgatctgactgacgtaagggtcggggatgtcgtggataaaatgcgcttcacctttcaattcagcgaggtgaccaagaattttatcccgtaaaagtttggcgattcggcctaaaaagcttggatcacctgctggactgagcagaaactggcatagatcacgctgttggttaattaaatgcaccatgttgaccatcaatggagatcgctggccggtagcaagggtgctgggatccatcgaagtgtccatcccgaagtccagacaatcggtgaattcattaagcaacgcggcttcggttttagccaccagatcgtctttatcgagatagtgcaaatagaaagtcccgcgactgattccgcttgctctagtgagatcggcaactgaaacctttgctaacgtttttttacgccctacagcaatcaaagaacgaacgagggcctgtttggtttgcgcagtttgttcggctttcttcatgatctcgctcctttatacaaccgtttaacattcaagttggttttaaagatgattaacacgatgttcatcataaaccattttggtagggaatacaaagattattgagcgacttcattttaagattgcctatatgctggtttatacgtgaatgagtcggtatgtcaacggcctgcgtagaaatgtcactgaacacatctgaaaaaattgcctatagtttcctgagcgtggcgggtttaagctgtttttgtaagatgattaacacgatgttcataattattttttggaggtcatcggcatggcaaaatttatcacggtaaaagatgaaaccagacaatatggctcaggtgaaagtactgtttatgccaatcataatgtttcgtttgaaatcaattcaggtgagatcaccgtcattttaggggcttcaggtgcaggcaaatcaactttgctgaatattctgggcgggatggataaaaccaccagtggtcaggtcacagtggtaggtgagaacatttctcaatatgatgcgcggcagttgacaacatttcggcgagagcaggttgggtttgtcttccaattctacaacctggtaccgaacttaaccgcactggaaaatgttgaactagccagcgaaattgcgccggacgcattagatccgcaaaagacgttggtggacgtcgggttaggcaaaagaatgaataacttcccagctcagctttccggtggggaacaacagcgggtggcgattgcgcgggcgattgccaagaacccgtcactgttattggcggatgagccaaccggggcgctggattataagaccgggaaaagcattttgaaactttttgaagacttttcccaccaaactgataagaacgtcattattgtgacgcataactcgttgattaagcccatggccgatcacgtcattgagatccatgatggcgaggtcaaagatgactatcacaatgatcagcccacaccggtcgaacaattgaaatggtaggtgacacagtttgagcaaaaaaatgctttggaaggatatacgcaaatcctttacaacgtcatggggccgatttttctcgatcttgcttttgatgatgcttgggtcatttgccttggtcgggttatgggttgccggtccggatatgcgagcaacaggcgcaacctattttaaacaatataatttggccgatttaaccgtcattggtgaagatggtttggatagccacgatcaaaagacgattcaggcgacagctggcgcaaagcaggttgaattcggttatcttaaagatgtcacgctcaaaggcacgcatgctagttttcggattatgtcaaaaccggataagatctcaaaatataagcttgcttccggacacatgccgactaagacgaatgaaattgcaatcgatgctaactacaaaggcaaatataagttaggcgacacgattaagtttgtgcaacgagcggatcaaaccggcagcaaggtgcttaagcggacgcaattcaagattgtcgggtttgtctattcgcctgaagtcctgtccgccattaacaaaggcgacagtacttcgggtagcggtgatctcaaaggatacggggtcgtcacagcgaataacttcgatagcgacttttatatgatggcgcggatcacgtatcaaaatacccagaagctggatccgtattccgatcaatataccgatcggattcaaagtcataaaacggctttgaaccaacgattgaaagatgcgcctgcagatcgcttggcggctatcaaaaagcaataccaaaagaagattgatgcgggtcaaaaaaagcttgatgaagctaaggcacagttagactcggctaaggaacagctgacaaccggccagcagcaattagccagtgccaagcagcaaattacggcaaagcaacaggaacttgatacggccgttaaaaatggccaagcacaaattgccagcggggaagcacagttacaacaagcagcgactcaactttcacaaagcgagttgcaactagccagtgccaaacaacaacttgaagccagtcagcaacaactggatgccaaacatcaagatcttgccagtgccaagcaacaattggatactgccaatcagcagcttgctaacagtcaggcgcagttggctgccgctaaacaagaaattgacgcagcgctgacgaataatccgcaaatcgctcaggtgccagtattccagcagaaacaggcgcaatatcaaaatggcatcgcgcagtataaccaaggccttgaacaatatcaaaataatttacaggcctataacaatcaagttgcagcctggaatacggccaataaccagcttcaacaaaagtaccaagaatataattctggcgcgagtcaattccaacaaggccagcaatcctatgcggctaagcaacaagaattagaacaagctaagcagtcattggcgactcagcagcagtcgggacagcaacaaattgaggcagctaagcaagaaatggcctcaaacgaagcaacgctcaaaaccaagcaggctgaatatgatcagcaagcgccaaacgcagaaaaagaaatccaaagtaacagtcttaaacttgaggatgctaaagaagcgctgaaaaatcttaaagcacctacgtacacggttgacactcgtcgtgaaactccaagtgggcaaggctacatggtttatgacaacacttcaaatatcattgattcgctagccaatattttcccatttttcatgtactttgtcgcagcgttggttacttttaccactatgacgcggttcgttgatgaagaacgtatcaattccggtacattggttgcactagggtatagtcggcatgatgtcatcaaaaagtttacagtgtatggtttcctgtccagcttaatcggttcgatattagggatcatcagtggacatatcttactgccattgattgtgtacaatgcctaccatggcggggttaatgttccgccaatcgaattgcatttttatcccggcattagtattgcggcgttgttacttgcgatgatcagtgcggttctgcctgcatggtgggttgcccggcgcgaactgaaagaacggccggctcagctgcttttgccaaaaccgcctgcaaacggctcaaagattctgcttgaacgggtcggctttatctggaagcgtatgagctttacgcataaagtgacggcgcggaacattttccggtataagaagcgcatgtttatgacgatcttcggggttgccggatcagtgaccttgctgttttccggcttagcggttcagcacagtatcggcggggttaatgatcggcagttcaacgacattatcaaatacgatatgatcgtggcacaaaaagacaatatcaccaagaatcaacaaacaagtctggataagctttttaacgaaaaagcggttaagaagacgaaatcagttcattacgaaaccgtcagcaaaaacgctggcgccaatcatgatcggcaagatatcaccatgattgtgccgcagtcaacgaagaattttgacagctacattcatttagcaacgcgcaaaggccaaaacaaactgacccttcaagataatggcggcattatttccgagcggctggcgaaactgttaaatgtcgatgtcggggatacgatcaccgttaaagaagcagatggtacccgtcgcaaagtcaagataaccggcattaccgaaatgtatatgggtcacttcttattcatgaacaaaacagcttaccaaaaagcctttaataccaattacaaggtcaatgggcatttggttaccttaaatgatcggtctatcagtaatacccgggcccatgccgcgcaattcatgaaagaagatggcgttaaaggcgtggttcagaattcttctttgaggaatcaaattacgacagttgtgaaatcgttgaacaagattatgggcgttttgattgtgttggcagctgttctcggcgtcgtgatcttgtataacctgacgaacattaacgttgctgagcggatgagggaactttcaactatcaaggtcctagggttttatgataaggaagtcacactctatatttatcgcgaaacgatcctgctttcgattattgggatttttgtcggctggggttttggtgaactcttgcatgagtatattatcaccgtcgttccgccaaataacgtcatgttcaatcccgccctttcagcgccaactttcattattccaaccatcgtgattaccatcatcaccgttgcacttgggttcttcgtcaattactcgttgaagagagtgaatatgttagaagcactgcaatcagttgattgatgtggcttgaggtctttccccaagcgttctaaaaagaaacaggtggcttaagttggaaaaagaccattgatttcgctatcgcatcggaaacggtgtcgagcagtctcctcgcagtgcctgagttgaggttgctcgattttcgtgatcgtcaatggaaaaagaacagataaactaaaggagacacgaacaacatggatggcacaattgattttcacacacactttttaccgaaaaaatacgcacaggcacttaaaaagcacattcccggtgatccggacggctggccgacgccgggatgggatgaacacctgacacttgggttcatgcgcaagaaccacattagttattcaattctgtcgttgtcttccccgcatttcaattttggggataaggacgaaaccgttgaaattgccagggatgctaatgagaccggttcgcaagtcacacaacggcaccgcgataaattaggttactttgcctctttgccattgccatatctcaatgaaacgcttaaagagatcgacttcgccttagaacatgatgcgctgggcttcaccgtgccaaccaatacgcggggtctttatttcggcacgccgatttttgacccaatttatgcacgccttaatcaaaagaaggcgattgtcctcatgcacccgaaccggccatcgcaaggtccgttgaacgtcaacattgacatgccgacaccgctgatgggtttctttatggataccaccatgacctttatgaaccttatccggtaccacttctttgatcgctatccggatattaaactgatcgtgccgcatgcaggggcctttctcggtattttggcagatcgtgatgctgcctttgtgaagcagcaatacaacgccgatatgtatgcgattttgcgccatgtttatttcgacactgctggcgcggttttcccacgtcagttaccgatgttgctgacactggcggatgagtcccatgtgctatatggcagtgatattccgtacacagctccgatgatcgccgcacaaatgttgaaactgtttgagcctgagacataccgcgccaaaatggcaaaccgaatcaccaaattgaaacactttgatccggttatgacgcattttaaaaagttccgtgcactaccaaccgtgctgaacatgtcgagtaaaatgttgaccggtgcggaaattttgtcaccggaaatggcgcaggatattttggtcaataacgggcaacggctgctcggtaaaatttgaccggattaaagcgtaaaacgccttatgcggtggcgggatcattcgtttcgagccgctgaatttaaaaatataaataatttcgttcggatttttcgcgaatagtggttttatctattattaaagttcgtattttgcttgtcatcaccttgcgatcctgttagactaccaattggcgggcaaaatcccgcactaattcgtgaggagcgattaattaatgggaactgtagttattgtcggcacacaatggggcgacgaaggtaaaggaaagattactgatttcttgagccaaggcgccaaggtggttagccgttatcaaggcggtgacaatgcaggccataccattcatgccaatggtcaagtctataaattacgcttgattccgtctggtgttctttatccgcatcagttatccgtcatcggtaatggcgttgtggtcaaccctaagagcttagtcggtgaactggctcggctcgccgaacaaggggtaactggtgaaaatctacgaatctcagatcgtgcccacgttattttgccttaccacattaaactcgataaattacaagaagaagcaaaaggtgccgataagatcgggacgacgaatcgcggcatcggtccggcctatatggacaaagctgcccgggtcggcattcgaatggcagaccttttggataaggatattttcgcagagcggctgaaggcaaacctgaaagctaagaacgaagaattcgtcaaggtctataacagcacgccaatgacgtttgatgagatttttgaagaatattacaactacggccagcagttgaaacaatatgtctgcgatacctcgattgtgctaaatgacgcgattgatcaaggtgagcatgtgttgtttgaaggcgctcaagggatcatgttggacattgatcaaggaacgtatccatttgtcacctcatcgaacccagctggcggtgtcacggtcggtgctggcgttggggcatccaagattgatcgcgtggtcggcgttgccaaggcatacacgtcgcgagttggcgatggcccattcccgacagaattgcttgataaaaccggcgacttcatccggaatgctgggcatgaatttgggaccgttaccggccggccgcggcgaatcggttggtttgacgcggtggttgtgcgccattcacgccgcgttgccgggattaccgacttgtgtctcaactcaattgatgtgctaaccggtttggacaccgttaagatctgcgtcgcttatgagcgtgacggtgaacggattgaaaattatccggcatcgttgaagttcctgagtgaatgcaaaccggtttacgaagaattgccaggctggaaggaagacattacccatgccaagacactagccgatttgccagaaaacgcacggcattatgttgagcgcatcaccgagctgctcggagtggatcttttgaccttctctgttggcccggatcgtgatcaaaccaacgtgattgcgaacgtgtgggataaagtgaagtaaccgatttgattaactaaaattttaaaaaagctgtcagtgcgagttttctcgtactggtggctttttttgctgtgcgcgagccgccgcggttagaagtcggagtgtaagcggccttgggcgtgatggccgggctttggccattgctcctgaggtccttacacgcagtcttctgcgacggggagcgcgttatcgaaagtgagcgtaaatactttgtcacatttaaaaaagcatttttaattgacttccggacccaaacccggtatattcaagttgttatatgaacacatgctcatatgaacattaaatataagggcgggattattgatgataacaaacaaaccaattggcttttatttgttaggtgtggctgcttttatcggcggcttattcatcacccaaccgttggcacgcgcagggctcttgattgctgctgcagtcgctgccgggtatcacgtaattgcagaaggcgtgattgagacgattcgggattccaaaaagcaacatcgatttgcgccgaacattcatattctcatggcattggcagcagtcggggcgattgcgattggcagttatgaagaagcggccatgttgattctgatttttgctggcgcggactttctcgaagactatgtcgagaataagagtcgcaaagagattaccgcacttttggcaatggcaccacttgaggcccgacgctatgggcatgatggcgagtttgaagtagtgcctgttgccgcattgcacatcggtgaccgcctgcagattctcaatggggcgcaggtgccgacagatggcgtgattattgccgggactgccagccttgacgagtcggcgatcagcggggagagtatcccacgggaaaagcaagtcggagatgaagttttcggtgggacgcttaacggccagtcaacctttgatatgcgggtgaccaaggccagtgacgaaacggtttttgccaagatcattcaaatggttcaaacagcacaagcgacaccgactaaaatggccagtgtgattcagcgctttgaaccactttacgttaaagtcgtcttggcagcattacctctggtgtttctggcaggaccgttattgctccattggtcgtggatgacgagcgtgtatcgcaccatcgtttttctggtggcggtttcgccttgtgccttggcagccagtgccgtacctgcaaccttggcggggatttcgaatctggcgcggcatggcgtgcttttcaaaggcggacggtacttggcaaacctgacgcaattaaaggcgattgcgtttgataaaaccggcaccctgacaaaggggacgccaactgtgactgatagtgaatttgctgccgatgttgatcaagcagcggtgatggcagttgtcacggcgatggaaaagcaaagtaaccatccgttagccaatgcgatcgtggctcattatccggcgactgatgtggtgatcgacaccgttcacaacgaaatcggcaaagggttaactgccgattatcaaggccatacctatacagtgggtaaaccgcaacgttttacgcatgcgcctgcgcttttccggcagcgcgccatggcgttggggcagcaagggaaaaccgtgatttttgtggcagtcgatcaaacggtggtgggcctaatcgcgttgatggatgaagccaaaagcagtgctaaagcggccatggcttacttgaaacatcatgatattcaaccggttatgattaccggcgatgcgaaacaaaccggtgaggctgttgccgccgatttaggcatcaaacaggttgtgaccaacgtgctgccagatcaaaaagtagcggtggttaagcaattgcaggaaacaatgcggccaatagcgatggtgggtgacggtgttaatgatgcgccggctctggcaaacgcagaagtcggcattgcgatgggttcaggaaccgatgtcgccattgacgttgccgatgtggtgttgatcaaaaacgatctctcccggctcgcatttgcccatcaggtttcaaccaaaatgaaccgtattgtcgttgaaaatcttgtcttttcgatggcggtggtgttgctcttagtcacgctaaatgtactgcagttaaccaacattgcctggggcgtctttcttcatgaaggcagcacgctcatggtgattctcaacggtttgcggcttttgctaacggaagaaggaacacattcacaaacaccgcatgtgcaaccacagctagggtaacgggttcggctcggtgaatcgttgcataacaaactgcgcttttaataccaaagtctgctaaaatgaggcttaagtatcataaggagcgcattgcgatgacaacgaatgatgttcatgcggcagctgccaataacagtgaaattccggatgacgccgatttacgagatgttcttgatgtattcaaaaccatgagcgatcccacgcgaatgcgaattattctcgctattgcacaaggacccattaccgttaacgatcttgcagccatgctggatcttggccagtcgacagtttcgcatcagttacggttattaaagcaggctcgattagtcgccggtgagcgatccggcaagcagatttattatcatttagtcgatgaccatgtgttggagatttatgcgttgaccaaggcgcatattgaggaaaagcagcataggcagtgatgaagtacaataacaggcggcgccaacatgcagcctgacattatcttttgtaaaggcaagtgtttttccggctatcaggaaggcacttgtctttttgcgtttattgccgtttatcctaacagaagaaacggctgcgtctaaaagctgatatttacattattagaagtaaatgataccatcattaaatccctgcgctcaggcagtttgctaaatggtagcactcatgacggctaatacgtccgacttaagcattggcgagccagcgtctcttttcatttgtagactaaggatttgaccgagcgaaatttaaaatgaaagcgttcgaaacttaaaggtgttatggaggtgttatatgtttgggcggcccataagtaatagatataagtactattggtatacagtcttcacgcaacttagatttaccagaatcatcaatatcatctttgttgtccaatttctaaaattcaatttagtacaattcggacttttgcagtcggtatttttgttatcgcagtttgcatcggaattgccaagtggtgttttaggcgatctttttcgaaaaaaagcggttattatttggggcttggttttactgacgatttcgcccatggtcatgatttcggccagtttggtaggcaacgattttatgtttacgaccttgttaggtgcttttttattggaaggcgtgggtaacgcgttgcttagtggggcggatgaggcgcttttctttgaagcaattcgcagagacggtcgggccaaacagtatgcaaagattcgtggtgaggcacagtttatcggggccattgttgtaggcgcggcaacttttttaggcggcgttttatatgcaatcaatcgcgtgttaccgtatttttttcagtcgttaatggtggcagttgcgggtctggttatcttttctgtgcgggaggataaacgcgtcactgcaacaattgaaaaagttaaggaacctagtcaagttaagaatatcctcaccgtttttgcggaaattaaagcatcgaccaatgttctgttcttatttatctttacggctttgatgtctgcaatggtaaatgccatttttgcgatgttgccagcgtatttttccaaactcggcttttcttcttctgcaaatggactgatatttatgctctttagttttgtgggcggattggtggcagctcaggcttatcggcttaccaaggtcagttctaaaacattggcgcttatcgtagccggtattttagggctgggggtgatccttcagatgcaagcaagtatttatttcttctctgcaggtgtttgcttgttgtacataacagtggatattctagatccgattgttctggaaatgttgaatctgtgggtgaaagactctgcgcgggcaactttaatctcgggcctttcatttgctactagtttggtgacgatgctgctcaatccgttaatcggtatgttgattcaagtatatggaacaattccgatgttagtgatggtttcaatgttcgcgattgtcatgatcctttttttcgttcattttagtctgaaatcaaaaccgcaagaaagcgaataaagtaatggaaggtaagcgcgcagattgatgtggacgattctgaacaccgatcaaggtcttgaatctaaaacgactttaaaacggacaagctgcttagtgagaaagtattttctcggtaagcagctatttttatggctaaggaatgaatggctaacatgcgcggaggttataactcgctgctgaaatgacgttattttaaaaataaatcgcaagcaatcaaatgatgtaaaaccactatatagtgtatgcttattttaacaaaccacaaaatttggtggatatcccgttacttttgcttctgaatcttgtatactaaatacattgttacaagttttgcaagtaagggtacgggaggactagccatgatcgaattttatacacaaatcaagaaacgggatgggcggatcgttgattttgatgcgaccaagatcagcaccgcgataaccaaagcggcagaaagtgtggcgaaactgtcaccgcgcgatgtgttaaccattgaccacttgacggatacggttacggctaagattcgcgatcggtatcatgatgatgttgagattgccgaaattcaaacggttgtcgagcagacactcattgccgccgaaaagtacgactgggcagaagcctacacgcaatatcggctgaagcgtgatttagcgcgcaaacagaagcaagacgttaattacaatgttgcgcggctggtcaatcgcgataaaagtgtcgtcaacgagaatgccaacaaggatagtcgggtgttctcgacccaacgtgatttaacagccggtgcggtggccaaagcgattggcttgaaaatgttgccgccagccgttgccaatgcgcatttgcgtggcgacattcattggcatgatcttgactataccccgttcatggcggaaaccaattgctgcctgattgattttgactatatgttgaatcacggcttctccattgggaacgccgaggttgagccggcccactcgattcaggtggcggtgacccagatgacgcaaattatcgctaacgtggcctccagtcaatatggtggctgttccagtgaccggacagatcaggtactggcgccgtttgccgagaaaaattaccagaagcatttgcgtgaattcggtgatgtgattgatgatcccgctaccctcaaagcgttggcggtgaagcagaccaagaaggatatttatgatgccttgcaaacgctggaatatcaggttaacaccctttattcaacgcaaggacagaccccgtttgtgaccgtgggctttggtcttggcactagctggattgaacgtgaaattcaaaaggatattttgaaaatccggattctgggtctgggcaaggaacgccggacagcgattttcccgaaacttgtcttcacgttaaaacgcggcctgaaccttaatccggatgacccaaactacgacatcaaacagttggcgattgagtgcgccaccaagcggatgtatcctgatgtggtttcctatgacacaatcaagcggctgactggctccttcaaagcgccgatgggttgtcgcagtttcttgcaaggctggaccgatccgaagacaggtaaggaagtcaatgccggccgcatgaatctcggcgttattacggttaacctgccgcggattgctatggagtccaaaggcgataaagataagttttggaagatttttgaagaacggatgcgcatctgcaaggaaggtttgctttacaagattgaacgaaccaaacaagccacgccggaaagtgccccgattctttataaatatggtgcatttggccaccgtttagccgataccgatagtattgacgatcttttcaaaaatggtcgtgccactgtatcgctcggctacatcggtctatatgaagtcggaacggtcttttatggttcagcatgggagaagaatcatgacgccaaggccttttccgtttcgattgtgaaggcgctggacgatcattgcaaggcctgggagaaacaatacggctatcacttctcggtttacggcaccccaagcgaatcgctgactgacaccttctgccgcgaagacactaagaagttcggcatcgtcaaggacatcaccgacaaggaatactacaccaacagtttccactatgacgtccgcaagtcacccacaccatttgaaaagctcgactttgaaaaggactatccgcaatacagtgccggtggcttcatccactattgcgaatacccgaacctgaagcaaaatcctaaggcactggaagcggtgtgggactatgcatacgataaaatcggttatcttggcaccaacacgccgattgatcaatgcttcaaatgcggtttcaaaggtgagttcacagcgaccgccaagggatatgaatgcccggaatgcggcaaccacgatccggctacctgcgatgtcgtcaagcggctttgcggctaccttggcaatcccaacaagcggccaatggttcacggacggcaagaagaaatcattcaccgcaagaaacatattacgttcagcctgaatcaggtggccaatcgccgcgataagtagggttgatcaaagtggcatggaaaaagataataggagcgatcgtctggagatcagacggtcgtttttgttttctagagactgaatataaatagtaatcggagacttttcattccgcccattcgcgtgtagaatccaaggcaagttcttgctgacggttggaatagcgtgattggaggtgtgccatgatagctggtgtatttactgctaaacaatggcaaatagcagaacaatggaataatgggtggctgattgttgcgattattgtcattttattcattatcttctgcctcctactcgtttctttttatgtacccaatccctggaagtggcggattttcgtacctgccatccttatttgcatgagtttgacggtttacagctggttgcgaacggacaatacggctaattaccaatttaatcaatgggccgcaaaaatcacaccgcagatccgcactaagaaagcggctctatttacttatgtctccgtcccagaaagtgaagttaaagggtatcgggcattaaatgattacccggcgcttacaagcttacccatgtatacgcgtcaccgagtcatagcatcagtggtctatcttgggcgtgatgacaatgcgcgctactttaagttagacggcttagtttatcgttattccggaccaatacagatcggcgaacaggcggctttaagcggttatcgttttcggttaaaggatcgtggctatactcaaatgggattcataaatccatccaagaattttacagccgctctagtgatcccgcgaaatcagattgagcagcattaccatccgtctaaggaggtcgtcgtgacactcgagaagatggatggtgaatggacgacggaaaaggtctatcgaaagtgaaaaagtttgtgcagtcattttgcaggctgacggtgtgggcagatgggttttgttaggataagcgagcctgcgccggcgatgaggacgagaactaattgcagatccatgccttatgaactatataaggacaagacctgtaagcaaatatagtagcccaagcgcagaaagggtcaaaactatgaaactaaaccagctagcaaaaatatgcgctaacttgctaggtatataaagcggggacttgacgctaagacagatagtcttgtaatacttgacggtaacaaatgcatcattttgggagaaaacgtcctaattggcgattaagcccttaactccccacaaaaaatagccgttacctgttcggaaacggctatgaaaatcaccggttgcttttactttggataaaggaattggctgtacaaggctcggacataacataataagagacttttttaacctatatagcctaactgcatgaatgctgtgtaccgccggaatcatcagagctgcatgtatgtggaatattatttaaattcatttatagttttatatctccacacaaaaagtgttgggggctctctaagaaaccggaacaaaaaacatttgattttctgtaaatttcaagcgcgttcttaagatttattggattatttcaaatagcagtacaccaattcaatctaggttattttttaggaatgcaagtacgttcttcttatccgttttcatgcttcctgccaagaatgcaactatgatggcaataacagagagcacgaattctaataatgaccacttgaaaattaacgttaagactaacggtacaaggactgcaattaacaagacgccatctctgggacctaaattaatataaggatacatcatcattgagtatcacttctttcgttgtctagctaggataatactagttgaaccatatcttcaaatgctattttgttctccttcaataatcgggagagttcttgggcgaacaagttagctttacgaaagtctacattttggtggttaaacatcagttggaggcggaattgtatccggataaggattgaattgtgtctcggaaacagggacaagaggacagatcccttcagatatcgtcactaagctggcgaatgatggtgattgtctatagttcaataccatcatggtcatctccttgtagctttgcgaacggaatgtttgaaaaaatgacccttatagatgagaaaagattgacgaaacagatggtaaacgcttactggactatctaactaaagtactacgcccttatcttttctctgtcaagttggatatggatacgaatgaaaaagttgatacttactcaaaataaggacggtttttatcaagcatatgctgtgataagctaagaacatcaaaaattctgcgaaaggcagtgatgtaaatgatcctgttaggtaacctatgccgaatggttacacttgttttcgtccttattagcagcattctcattagcaagccaaaaatgacgcggattcgttttataaaactagcaacactagcaattaccgccgctgttttcttcgcactgagtctgtggctggagaaagaagcctctggtgccgtttcatcgttagtagggatggtgatggttgttattgtggcacttgaactgggatacatacgcaagcgcaagatggtcacgcgttgagaagtactcgcacatgcttattttgcatgctgacgatgtggccagacgggttttgttaggatgagcaaacctgcgccaccgatgagaaccaagactatttgtacatcaattccccgaaaccagataagatataacgctgttaggcaaaagatcaagcccattaaagaaaaaaaggtggctatgagtaaacggcttgtaatagaccaacttgcaaaaatatctgttgattttggatcagaggcccgactccaaattaacaaaacgatggcataaattgaccagataacctgcgcaagccaatgagggaaaaagcccaagaatgttgtcgctgccactccagtcatgattagactagccgtcatcaaaacagccataacaagctgatgccggctcactttactatccttaatcaatttttcgtttaactcagaatcgtcgaggatcagggtatcaagcgacaccgaaaagatccgggcaatttgagtcactgtttctaagtccggtaaattgcgttcattttcccagttagataccgtgtgccgcgaaacgtgtaattgttgtgccaagtcagcttgcgtcatgctgtgtgcggtccgaatctgctgaagctgttttgaaaagttcaagatgatcacctcgcttggtttgattgtggcagaggaggtcagaaacagcaagaaagagagaagatccgcagcgcgcgttattcgagacaagactattacccgggaaattttgcattcggtggctggtgaaaaccgattaccaaagcaaaaacttaaaataaatgtcaatttgtcagcattcgcagtgttagcagaagatgctcctgcactaatcgccataatgtttgacaagtaaatcatcatgcttgtgatcaacgcacatttcatgctatactccattcggtgccaaaccacggtgagttcgtaacgatcggcgcgtatgcgttcagaaggtcgaagcggctcgccatttttttatgagcgcgagccggcgcggttagaagtcggagtgtaagtggcctcaggcgtgatggccgggctttggcaattgcgcctgaggtccttacccgcagacttctgcgccggggagcgcgttatagataatatgaagtgaccccctagattgtcgactcggggatttagactgataatggtgttgtgttaaaacgagccatacaatcattaccccatgacaataggaggtcactcacatggaaagtatagtttacgtcgggatggatgtccataaagccacttacagccgacggcgtcaactttttgtgggtttaacttgtaaactttttgctagaatgctttttcaacttacaactgatgtgtgataccgtattgccagccgcgatgtttcccactagcgagttctacaaacgctgcttgcgccgcttgtgagtatttcgtggctgctgatttaaactgaatcttaatacgatcatcaacgcgaatatcaatctttgtttggtgacgttccttggcttcggcttctaaccgctcaaaaacgtttccgcccttaagcacgtatacccgcgtctgtgataaattgtctgtgccagtttgtgaccagcccattggccgcgaactgaagcgctctgaaagcatatgactaatatgaccttcagctgatgtcccgtgaaagtctggatcattgttggcctgaatttgtttccaattcttgtgaatgagcgttcgtgcttgtcggacagctttgcgttctgacgaccgtaactgagggtcattgagccgaacacggaaataatcatttagatagcttgagtgcccttgtaacgcccaatgcatgagaatatcgcccagattaccgggtacgccaattgccgcttgtttgcacgctttacgtaggtgaaatttatcgtagaccaccgtgcagttgggtagaaaatcggccccggttttgatccaactggcaccatcaccggccagaaaaaagcgtttgggcatctgaccgccatattgtttcatgatgcaatcaagcgtggtttgccagatttcttcagtaccagctgttcccgggtattcaccggtaatataaaatggcctaatcaactgaaacttcttacccacagaccgataaccttcatgtacataaaccattttcaagaaatgattggtgccgtcctgatgggggacatgatcttcatcggcttcgacaaataatgtttccggtacgggcattggttgatcctttaactgatccaaagcgctgatggccttcccgtctctatgaacaacatgcatgacggtgctcttcgatggttttgtacccccgccgttacgatctcctgattgcttgtaagacatttgggcggcatcttccagcagcttagctttgaggtcgagcgaaagtcggctacgcttctcaataccaacgagttcatcaagcaagaagacacgctcgccagtccgtttatcttgataataacgtcgggtgaaaaccagtgagccaatggatgccaagtaagtgcgttcccgcttatctttgacgctatagaatcgacggcggtaagcactgtccataatagcttggtccacttgttccagtgcctgcccaactaactggcagaggtgctcacgaaagttttcctgattggttaaaatgaattgacttaaatccagcttgcccgcgaccatctccatgacagattcatcaatttctttcaacatttctaaaatgatttgttgtactataggtgacaagagcgaattcctcctactgctatcgtgtttttcttgcaattaacattctagcacgaagggattcgctccctttttgtttgctcagatatcacccacttaaactttacgccatgcttacagcctatgcgcgttagacaaagcaacgggtgcgctcttagctgagacccagtgcgcttcagagccaaaattagtcgaaaaatttattaacggattagctgaagaactggatccagacacaaaattcgtgaccgggtatgaggctggtattttaggatattcactctatcgttcactcaaaaacttaggcattgactgtatcattctggcaccgacaacgatgtatagttccgctaagaacaaaatggtcaaaaatgattcaatggacgcgcgaatgatcgccaagaatcttgcagctaatacgtattgtgccgtttatgtccctgatgaagcggataacgaggtgaaagaattcattagactacgtaaaatgatgaaaaaggacctcattagagtgaaacagcaaatcggcatgttccttctccgtcaaggattgaagtgctcagcatccaagtggacgctggcctatatggattggctaaagaaagtcccattgtctccggtattacggtcagtgcttgacgaaatgacgctgcagaaatctgaattagaggaaaagattgcccgctacgaccagaccatcgagacgtttgcgaacagtgaacgttacaccaagcccattcacgcgttgacaagtatgaagggatttaaaaccacaacagccatgaccatccacatcgagattgcggacttcaaacgtttcaaaacagctaaagcgtttatgtcttacgttgggctaaatccgtcagaacattcaagcggcgatcataccatcaaaggggggatttcgaagcaaggtaacagtatcgtccgcacaaccatcattgaagccacacagggattggtcaagggcagcattgggtacaaatcaagagccctaaaagcacgccaagcaggacaagaatcagccgttattagctatgccgataaggcaggcgctcatcttcatcgcaaattcacgcggatgcttactcaaggaaaatcatataacgtggcaatcgccgcagtcgcccgagaactcgctggatttatctggggtatggaaactggcaatatcaactactgatcaccaaagcgcaattgagcccgaagattcaaacaacaaagatgacagcaagaagtatcaaggactaaagcgtcacgatattgtcgctggtagcaacaagcgtcagaattcaacggtctggctatttacgagcgttctattttggcacaggctcgccctgggtatggccatatctagagacaaagagtttgtgatccacgactatagattagattctaaagccttcgacgggaccattaacctggggtagccaatccccgtataacagagtggttaaatgtcgagagacaacggaattctggagcttgttagtgccaacgacaatatcgaaaatcttataaagatggggttgacaggggtcacttcataacagaacgcacaagtaaacaaacaaagcccccaaaatagaacgcattccagtctccacccacaatgtcacaacaccaaaaaaccgcagccatttcaaaaacggctgcggttaaacatatcactaagtttcacccaccgacgctgataaagtaaacttcaagcggccggctctgtatcaagcttctttgatttcgaacgcatcgtcaacgcttcccagtcaaccaatggcaattgcgccaccgcacccagaatcaaaatcattgaccaggtgagaatcagactcatggtcacatcaccggtgaaatgcgcgagaatccggacccgcgtataagccatcaaagcgccgtaagcgaaagtgagccagaagactaaccgttgacgcttcggctggtcacgatcaacgaaccaagtcaacgtgaggatggtcgccgcggtttgggtatggccggacggaaaactcatgtgaccgttagcaccatttggctggaaccagctggtgaagtgtgccggattaccatttaattcgtaagggcggaaacgaccccagaaggttttcatgacgttcacaatttggtcggacatgatgcaaaccaaagtggcaactaccgccacttttaataagtaatggagctgttcatcgcttttacgtgaaagccagtattgactgccagcaaacacagcaacgtagagcactaggaacaagatgacgcttagcccacccggaagagccagcttgctgccatcggaattggccattcccattggcttgccggcgttgatgtcgttgattgaagtgatcaccatcgtcatcgcgtatttcagataaccagcccacagttcccagccggcatagatgacactaccgatcaccatcaagccgcgaatgtaccatgcgagttgcgatgatcgcagcgcatagtgacaaacaacattacaactcaacataataatcagtggcgcagtccagaggccaacgtcttgaaaaagggtggcaaacggatcgttcatgttaccgatcgtttgagaaatctgccaatcaaagccagcagctgcagccaacaataaaagtaagataccagcaacaatcagaaaaatatgtttgcggatcggagcgtttaatttttgcgtttggtccatatcttttccctcccatgtactttgaaaatagcacatagtttacagaaaatggccggatttacggtacctgtacgtaacatttaagctgccgatacgaaatttacagagggttgctaaagtaaggctcgtcaacggttagctggcggcgatcaaagttgatggttgcctgtaaaccatatggtaaaacggtgcggggataagcgtggccaaagtttaagttgtagagaatgggcgtttgataaggttgcgtgacatccaagagcacctgctgataatctgcaaaataggtttcgttttgaggcttacccactaagatggccttcacttgttgcaagacaccgtgatcagccagatgctccaagtactcacgataggtggcaggtgaaattttatcttctgaagtctcgatgaagagaatcttatcagtccaatcttgcgggaaaagatgatactttttagcaacttgcggctcatcgtcgtaacgcaccgggtagagcaagtcgtgaaggctatccaaacagccgcctagcaatgttccggtaacctgaccatgcccacgcagcgctaaatagccatgctgctccggatgcgctttccgcggcacccctaactgatccgcggaaaagtcagtccgctcttcgtaccaggtaggactggaagtgatggcagtcgttgccggattttcgaaaaagtgttggaagctggcagcagtatatggcaataagtgcgtatccagctcagccaagtcgttcaagaagttcggtccgtaaaaagtggtcatgcctagctgataaaacatgagatggttaatggtggtgtcggaaaagccggtaaaaattttaggctgggtttgaacagtcttaataaatgccggatcgtcaagtaggtaaggaacaatgcggtaagtatcatcgccaccgatggcacaaatgatgcccttaatgtcgggatcggtcatcgctgtttttaagtccgcggctctggcttccggatgtacgtttaaataatcacgtccgcgtaaagcatttggcataaaccgaggtgtcagccccatatcctccaaacgcttaatgccaagttttcgttgatgggcagcaaacgcctcaccaagtgtgccggcactgaggctaacaatagcaacttgatcatgcggttttaaagtctgtggttttttcaagggtatccctactttctagtgtgaaaaattaattttcgtggatagctttctttttagtgtatcgtttaaactaacctttgtcttgtatcattttttgaaagtctgcctcgcttttgattgatgccgacattcaaactgtgaaccagttgcttgtcttctaagccggcaagctggtacgatcgaatagaggattgaatgaactgactttaaaaagtaaaatgaccatttttgccaggatttaatggaggattgagccatgtacaccattcaaactgctgcaaccattgccggccgcggtactgtaattacgattgctccgccgattgagcgcattcaagccggtgatcccgttcggctgaatggcgcaacagtcggcaaggtgtgtgcgctggaaaaggcccgccatccgcatcatagtaacaatcagccgtgcctgagcctactgattacggaaccggtggaggtcggcgataccattgagttccctaagtcacaatgttggcattaggcatcatatttcttttatgtgggtaacggatcttcgtgccatcaccgccctgaccacacacctacatagaaaaagcgttgcaattgtcagatgagagctgacagtcgcaacgcttttcgtttacttgttctagtgattggctgtggtcataatgccggcttcagtcatgccttctgcgtaaagtttcagtttaccgttgataatgtccataacgagatcgccatattctacgccatctgcttcggcttcctgtggtaggagcgaaagtggtgtcatgccgggcaggttgttggcttcgatcacccagacacccttatcgttggcaaagaagtcaatccgcccgtagttttgcaatcccaaaacgtccatggtttgtaacgagacatccttcattgcttgatgaaccgattcatccagattcttaggtggcgtgatgaagtcggtgtagcctgcttggaatttgtgcttgaagtcgtaccaaccggaatgcactttaatctcaatggcagaaaacgcccggccattgacaacgcctaaagaaaattcgcggccaggggtgaattcttcaacaatcgcactgttatcgaaccggaaaacatctgcaatgccattttccaattcttcttgattgtgtgcaatgtgcgtaccaacgctagagccgcctgatgtaggcttaacgacaaccggaaagtcaaacggtaccgtatgcttaccattttgattgcgcttgaattctttgaacgccgctgtctggatgccgtggtataacataacttctttactgaagactttattcatggtaatgccggaagccagcggaccggaaccggtatatttgacgttgttcagatctaatgttgcctgaaccttaccattttcgccatcaccaccatgcagtgccaagaacacaatatctgcagccttgcagatcgccaaaacgttaggaccaaacagttgcgtgctgccgtctatccgtaacttgttgatgtcggcgtcagtcagaatcgcatctgaaattttcagatccttactggtgttggcatcatcaaacacttggtcaaccgtttttccctcaaggtcgtagccaagaaacaggtcaatgaaggtggcctgttgccccttttgtcgcaaggcgttcgtgatccggtagccgctggaaatcgacacattgcgttccgtgctccggccgcctgctaaaacgacaattttcatgtgatagtacctccgcgtattatccgagtttgatagaaactaaagtgtagcacaatcaaggcgcaaccgctatcaggacgcgttgaattgtagcaaaaattaacatccgtgcttaatacggttaggcgctgatacttaccaaatttgagcgagtcgagccagctgccatccaaagtttcaaattaacatcatagcaacatttcattagcaacttataaacaatcgcttggcatatttagtaataatcaatgagaaatggaggtgaacgactatcgccactggattgaatatgatgatcgggattgtaggggggattgttgtcgcaatactcgctaatcgcattaacaggccagcgacgaaaacccgcggcatcgtcacgaacacgcttggcatcacttttggcgctttaggtgctcaggctgctgatcagttgctgcatgaaggtccgcagttgtttggtagccaaattgtaccggcaattgttggtggtattgtgcttgcgtttgttgttatttatgcaggcaagaaatggtttcgtctaggttccaccaattaagggagacattcagaatgaagcaaagaagacgcgtggtcacgatgctgttgacgggactttttaccataatagccgccgtgatcttcgaagctggcatgtgggtttcaatgtattggtgtatgaagttgttctaaatacttaataatcccggcagatcgttgggtagttgtcgccgtttgagatagaaagaggtttttgttgtgaaaaaaagagcgaatggtcttcagtctaaacacattgttggtgggctagttgcgttaggtagtctgcttgtagcaatcctatttcctgctttcaagagataaactgcaaccctgaaccaaacaaataaccaaactaaaacaggtattggcgatgcattgcgcaaccgtcaatacctgtttatttgtatgctttacggttaagtgatacccagcatgattgtgataatcaatcatgcgtttgatcagtgaatctgatactgatcaatgctcccaaaccgatcaaaaccagtaagctgccaacgcccattccgaaaatgccggttacctgattcgccatttcctgttgagctgacaacagcgcatattgtgtcaagacaatggccatggcgccatctgccagattaaatgtttttaggaaaaataaggcgccatggtgaagccgccggactcgtaagaagccgatgattgccatggtaagcttgtaaaagccaatggttgcaactgtaatggcggttattttaccaaaccgtgcctgatagccatcgtgatacatgatgaatgcacagatcgtaaaggccagtcctaaaacaacataagcgaggccagcggtttgaacaaataccttggtttcaggtagctcatcatattgacgagatcgcgaatagtggtgtagaaaacttgagcgagcaagcgataagatgaggtaatagccgccaaacaataatagccataaagaaccggtgaccagacccaatcccaacttgacgagtgcaagaataaaattaatacccgcagccaaagttcccatgagagcggttcgatccgccggggtactggcatgacgatgaaacaaccggcgtaatcgctgcatggtaaccctccaattaactaatgtttttggtcttcagcgacaaccacttctggcgttttcgaagatttaacactttttagaatgatgatcagcatcaagacgacgatgatcgacatactaataaaagtagcattcacgccaccaaccgatgccaccacagtttgctgtgctgcaccgcgattggcgataaatgacattaaggctacgctaaccgatgtcccgactgctccagcaacggttcgtaaggtggtcaaaacggcagatgccgaggcaatagctttgccggttagctgggtgacactccaggtgaccagtggcatcattaagcaggataagccgatacttcgcatggcccatacaacagtcagatagatgattgaagttgaagtcgtcaaaaagctggtgccgagactgctaattaggactagcaggacgccgataattgcaagcgggcggatgccgtaacggtcgtataatcggccggtgatcgggctcataattgccatggcaagcgaaccgggcatcatgatcaggccagacatggtggcggagaggtgatggacggtttgtgcgtagatcgggaaaacggtggaaaccgccatgagaacggcatacattaacgcgcttagaattactgcagtccggaagaccggatctttaaagacgtgtaaatcaagtaatagttgatcaacatgcaaggcgcgatagataaatgccatcccggccacaactgctaacgctagcggcgcggcaattgccaaactcagaaacggtgcggtaccaagattaccgaagccaacggtaataccagtaaaggcgatactgatgagcaagaaagactgccagtcaaattgcagcttttcggtcggcaagacatctttgataacaattaaagcaaaaataatatccgctacggcaacgatgacgccgacccagaatatgacccgccagctcatgtaatcgattaagaggccggtaatcgtcggcgcaataatcggggcggcactggcagccaagccgtaaatgcccataatgccacctcgtttcgaaacggggaaaatagttaaaatgacgacttgcgttaacgacagcaggataccggttccgagtgattgaataatccggcctaccaataaaatggcaaaagttggtgcaagtgcagccagcagtgaaccgccagcaaacaagagcatgctggcgatgaacaaggccttggtcggaattcttttgatcagaaatgccgttgcaggaatcataatccccatggccaaggaaaagccgctggtgagccactggccggcgttagcagttacgccgaaagtcttgatgatatcgggtaatgcggttgtcagcgcagtttgcagtaaagacgaaatcagggtacctgtcaataatacagcaaaaatcaaatttcggttcttagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcacactgtctaccgctattacgatatgtggcgagataaaccagacccgacagctgattcgctattagaaaggcttttaaaaaaactgtcgcttcctatcgttttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaacggtttaccacaagccattctcgtgacacgagctaatgtatcagatcgttcaggtgcattggctatgcttagtttggctagccaaaatttagagctggttcagcatgtcatggttgatggtggctacactggcaatgactttgcggatcaggtgaagctcattttgaatgctaagacgacggtagctaaacgcaacgagttgcatacgttcacggtgttaccgcaacgatggatcattgaacgttcatggagttggctagacaaatgtcggcgactttggaaaaactgtgaacgtgcccttaacagcagtcttcaaatggttgtattggccttcctgaagatagttcttaaaagatactagacaggttcttaggtgcagattgtttcattctttttagcctctaatctgaatattagtgtgacgatcaaaaaggaatctggagggcgcattattagttcagcagtaaaaaagcggccttgcttgtctcggcaatggcatcaagttgttgatcaatcagaggatcaattcttgccgaacggcgggcctgccaccagcggtaagcaaaataggcacttccccaggcaagaaaaccgggaatagctaacataaccgatagcaaaatcaatgcggcctcccaggcaaaaaccgagccagccatgaatactgtgccaacgatgccgatcaacaggctcagtgaggttgcacttgattgtttcgatttttccaagcgcacaacatgagccatttgttgttcaaattgcttctgtagccgattaagttcgcttttatgggtaatggagcgatcgcgcttgaacgctaaagtgacaccgtgcagtccttcttttgactcctgtaattgccagccgaagtttgcataaccgtctacataggtggcttgcatactgggagaaaccgtctgggtcaaatattcataggcgataaaactgtttttttgcataaagagaaaccctccatatcttgttataggcgtttgccaagctgatttcgggtggctaacgactgctcatggtttaagcatacggagggcgtgtttttgaattattcatgaaatgttgctgaattgttaattttcactttgcggaagagatacggtgaaggtagtaccttggtgagggttactttggacactgatttttgcattaagcaagcgaataacctgcgccacaatggcgagcccaaggccatttcctgcacttgcatgtgatgtatcgccttggtaaaacttatcgaaaatatgtgcctgcgtattttcgtcaattccctgaccatcgtcgtgaatatggacacgtagcgtggtatcgtcagcttttgcgcgaatcgacaggtgaccatgtggcggtgcgaatttaattgcattgccgattagattgtgccaaacgatctcgaggagttggggattactgataattggcagtgagtcgggtaaatcaattgttagatgtaactgtttagcatcaatcgcattggcatcatccagtaagcagcgcgtcagttgcgcactgagatcgaatttttggtaatcaggtgccgtgacttgggtttgtagtttgttaagctttagaatattcgtgacaagcgttgctaaatgggcgaccgaatcactaatggtggtcaaataaagttgctgtgttttccggtcaagccctgactgttgtaatgcttgggcataaccttgaatatttgccaacggtcgtttgaactcatgtgacacattggcaacaaagtcactacgtagggtttcggtggagcccagttcggcgaccataatattgaagttagcaaacatcgcgtctaggtagtcgtaattctggggtgcatgaaccggttgtaaataaacatcaaagttaccatttgctacttgttcagcggcatcgctcaaagctttaagtggcttgtcaaaagcgcggtatttctgccaggcggtgaatgcggagaagccggcagcgaccaatgcccagtaaagcagataccagcctaataacggcgtcaacactagatgccaattattaccataaagtattcccggtaaggctgctagaatgctcaaggtaaagaaggagccaaagaattgaaaccatgaaaagtgttgctttacttgtggttgaacggcttgctcatttactgatttcataaggttaacaccgccttgtaacctaatccatgaatggtcttgatcgtaaagccatctgctgctttgaatttctcgcgtagttttgtaatgtatacatctaccgcgcgcatgctggtatcactggcaaggtcccagaactcgttgataagttcagctcgggaaaaagcgtgatcaggatatgaaagcaatttataaaggatctggaattcccgaactgtgacatcaaccgtttgatgattgacttgtgcagtaatcgcctcgttgttgagagtgagattgccaacgatcaacaagttgtcggccgtaatttttgcgcggcgtaacaaagctttgattcgtaatagcaattcattgaagtttatcggcttaaccatataatcatcaatgccgctattaaaacccttttctttggacgcaatatcatctcgcgccgttatgaagaggatggggatgcttggatcggttcggcgcagttcttgtgcaaattgataaccgtctacctgaggcatcatgatgtctgataagacgagatcgaattgttcggattgcagtaaatcataggctgccggtggattttcggcaccttgaacagtgtaaccattctgccgtaagatggttgcaatcaggtcgttaaagttgcggtcatcttcaaccactaggattttgaccaaagtaagtctctcctttttggtacgtgtaagtcgggttttacgctgcgggtcgatgggtcgttgtttgctgaacagtatactgatcccagacatatttgtcatggcttagcgattaggtggataggctggcatcactgatagcaacgagattcgcgataatattttttctgagtgggcgattttttaatggaaaggatttttctatgcaatatacatggctaaacatgcctgagcacaattacttgattgtggttgatcaaggtaagcttgcttttgtcggatcgccggatgccaaactaagcgaagcaacgcgttatatcaaagggccactggtatttgatcgcgaggagatgttgccttttcgcaatgcaatttatgattatttaagcggtgacagtcgggagatcgcggtgccgttagtctttcatggcacaaaactgcaagtggcggtatggcgttatttgatgacaattccatatggtgaaacccgaacttacaaacaagttgccgcagcagttgatcggccacgtgcttttcaggcaatcggcaatgctgtcgggcggaatccattaatgatggcgattccctgtcaccgcgtattacgcacagatggcggactaggcgggtttcgcggtggcttaacgttgaaacgcaaattgttagctttggaacaagggcagcatccaaccttttaatcagtagtaagtttttcaaaaggtagcggttaaacgttctattttacgagcataatcttgtatactgatgaatggacaaatcgaaatcaaggagatattgagaatatgaagattattgcatatggtgcacgcgtggatgagatccaatatttcaagcagtgggctaaggaaaccggcaacacgctggaatatcatacggaatttcttgatgagcatactgttgaatgggcaaaaggctttgacggcattaactcactacaaacgacgccatacgcagctggtgtgtttgaaaaaatgcacgaatatggcatcaagtttctcaccatccgcaatgtcggaaccgacaatatcgatatggcggcgatgaataaatatggcattcgcttaagtaatgttcccgcatattcaccggctgccattgctgaatttgcgttaaccgatacgttatatctacttcgcaacatgggaaaggttcaagcacagctacaggcaggcgactacgaaaaagccggcaccttcatcggtaaagaacttggtcagcaaacagtcggcgtgatgggtaccgggcacattggtcgcgttgctatcaagctcttcaaaggttttggtgccaaagtgattgcttacgatccatatccgatgaaaggcgatcatccggactttgaatatgtcagcctggaagaactattcaaacaaagtgacatcattgatcttcacgttccgggcattaaacaaaatacccacattatcaacgaggcagcgtttgatcttatgaagccaggcgtgattgtggttaacaccgcgcggccgaatctgattgatacccaggcgatgctcagcaatctgaagtccggtaaactggctggcgtcgggatcgatacgtacgaatatgaaaccgaagatctgttgaacctcgccaaacacggtagcttcaaggatccgttatgggatgaactgctcgctatgccaaatgttgtcctcagcccgcatattgcgtactacacagaaaccgccgtgcacaacatggtttacttctcactgcagaatttagtcgactttttgacaaagggaaagacgaatactgaagtgacagcaccggcgaaataatttaagctgcaaaaataagcagcaggcgctctgtttttcggggcgcttttttgtgtgcaaaaattcattctatgactaactcgtcctaaatttacgtagaatcttagcatggtgctacgaggggaaaatcaatttataaagaaaccgtttacaacatctagataatctgctaatataaagtcgttcgaatgaatagtcgttcgaatgaatatttaatctgacgcgcgtctacagttggaatgtaaccctttattcgaaatgcaaagtgaggtaattttttatggctaagaagacaatcatgcttgtatgtgctgctggtatgtcaaccagtatgttagttaaaaagatggaggatgcggctgccaaagaaggtgttgatgcaaaaattttcgcaacatcaactgctgatgcccacgacaaattagattccgaaaatccggatgtgttaatgctcggtccacaagtgcggtatttagagagcgacttcaagaaggatctgagtattccggtcgaagttattaacatgcaggattacgggttgatgaagggtgataaagtccttaaagcggcgctcgatttaatcgacaaaaagtaggaggctctcatggacgaaaaacaacagttgatggtgatgcaactgatcatggctggcggtaatgcaaagggatcggcatttgaggcaattaaagccgcaaaagttggtgactttaagacagcggacaccaaactaaaagaagcagacaaattcttggccgatgcgcacaatgcacaaaccgggatgttgacagatgaggcacaaggccatcatcaacccgtttcgttactaatggtacacgggcaagaccatgtgatgaatgccatcacttttcgcgatttggcaggcgaagtcgttgatctttaccggaagatttcacaggagtcgaattaattaagggagtgtgaaggtcgtgccaaaaccgagcgagtcgaagtatgacaaaggccgccaagagctgagtctaaccagtatgttttttaatcgctatctattgattcgatatacgaccgcggctttcttttttgctaatttatactggttctttttgagctttagtgctgtaggacttgcaaagtggtggcctttcactttgatcctcacgaccgcagcgattgcagttgaacaagttagtaaatactggcgccgggataataagctaccggtaactaaagtcggatatgcaggacaacttctgagtaactttttggcactggttgtcattgtgaccggtcatggggcaagcattttcccgtttttcgggcaaaaaggaatttcgctgatcaccacagttttattaattggtctgggtatttgtttttatattttggctcgggttcatttaatcgaaacaaatcgtgatcgctatttaaagcgaatacgtcaatttgcccaaagtcttcaataagttgaaacgaggagattaaattatggattcgagtaataacaaactatttaagtttatgaacgctcacctgatggggccaatggggaagctggcctcgtttagaattgtgcgtggcgtgatggcagcagggatggcatccattccgtttacgattgtcggttctatgttcttgattattaatgtgttaccacagagttttccaatattgacagggctgtggaagaactcatttgacaagatttcaaacctctacatgttagcaaacggcgcaacgatgggaatcttgtccctttatttttgtttagtatttggctatgagtatacgcggattcaagcacaggaagagaagattgatgtgaatccgcttaatggcgctctgctttcgatgatggcattcttcatgtgcgttccggaattggtcttcaagggtgggacggcaactttaatcaccgagataactaaggacagcaagattattgacggatatgcgattgccggtggcgtcacacgtctaggaactactggcatctttacggccatcatcatgtccattattgcggtaaaactatacgcatggtttgttaagaagaatattgttgtcaagatgccagacaccgtaccagcaggagtttctcgatcatttacggcattgattccaactgcagcaattgcactaactgtcattgtaatcaacggtatcttgatgatcttcaataccgatatttacaaaattgtggcgatcccatttggctttgtgactaatctgacgagcacgtggctaggattacttgttgtgtactttatcatgcatgctttatggattgtcggcattcacggggcaacgattgtgacctctttcttaacgccgattgtactttccaacatgcaactgaatcaaaagggcgccaatattccatttgctggtgaattcaataactgttttgtcacaattggtggttccggtgccacattaggcatggttatcttcattgcattctttgcaaaatctgctcagcttggtgctttgggtaaagcttctatcgtacctgctttctttaatattaatgaaccgattttgttcgggatgccggttgtttacaacccatacaccgccatcccattcttcttagcaccaatggcttcgatgaccattgcatattttgccattgacttacacatggtaaaaccgatgattgcacagcccgcatggccaacaccacttggtttgtctggttttattggcacggcgggagactggcgggcaatcgttctagcctttgtttgcgcattcgttgccttcttgatctggttcccatttattaagttttacgatggcaagctgtatcaagatgagcaaaccaaaggcgcacaagaagcggctgcctaaggttttgttaacggtgatttagatgatttaaaaggaggaaaaaagttgtcagcatttcctaaagattttttatggggcggcgctgttgctgctcatcaatttgaaggtggatggtcagctgatggaaaaggaatcagcattgccgatgttatgaccgccggagataatcaaaccaaacgtcgaattacagatggcgttcaaccgggtgaaaactatccgaaccacgatgccattgatttttatcaccgctataaggatgatgtcgagcttttctcggagctggggcttaagtgtttccggacgagtattgcctggagtcggatttttcctaaaggcgatgaggaacaaccgaatgagaaaggcttgcaattttacgatgatttatttgatgatttgcttgcccatcatattgagcctgtgattacgttgtcgcattttgaaatgccttatcatttggttcaggcttatggtggctggcgtaatcgtaaacttatcggcttttttgttaaattcgctaaggttgtctttgaccggtataaagataaagttaaatattggatgacctttaatgaaatcaataatcaagttgggatgcttaatgaatggtcgttatttacaaattcaggattgatcattcatccgggcgaaaacaaagagcaagctatgtttcaagcggctcattatgaggcagtagccagcgcactagctgtccaaatcgggcacacgatcaactccgactttaagattggctgcatggttgcaatggggccggtttatcccgcgactcctaatcccaacgatgtttttaaagctgaacgaatgatgcagacaaattattatcttgcggatgttcaggtgaaaggacactatccggcctttttagaacactattttgctcgacgccaatttaatttggacatcacattagaagatcgcgatgtcctactggccggaaaggttgattacattggattttcatattatgcgtcccatgttattaaagccgctgatgaagaaccgactgatttcataacattgggttccaatcaggagattaaaaatacgacattacaccgctcagattggggctgggaaattgatccggttggccttcgttatgcacttaactggttcagtgatcgctatgatgtaccgttattcatcgtggaaaatggtctgggcgcgtttgataaagttgaagaaaacggcagtatccatgatgactatcgcattgactatttacgccagcatattgaacagatgaagttggctgttgaagttgatggggtcaagcttatgggatatacaccttggggcattattgatcttgtgtctgccggaaccggccagatggagaaacgatatggcgtcatttacgttgataaagacgatcagggaaaaggaacacttgccagaagtaagaaggattcttttgactggttccataaggtcatccaaagcaatggtgaggatctcacctgaacttgcctagataaacagtgatactgatccacgtttaagctaaaaaagaagcccaagagaatttttttactcttgcggcttttttattgctactttgaggtgatcgtcttttaatatgacatgccactaaatggattgactagttcatctattgaaatggggttataattcaggctaagactttacgaacgagtatgagtgacgaatatagaggagtggagaagttgtcacaacgggaaagcagttatagcacaaaagaacttgtgaatcagctgctgaaagatattcaacaaggcgtgatccaaggcgcagatgggcaacttccaactgagccggagttgatgaaacagtatcaggttacgcgatatacgttacggcaagcattgaagaatcttgccaacctaggttatatctatcaagctcatggcagtggtacttttgcacgcccgcaccatgtagaaggcgcaatttcgcttcaaaataatgttggactgacggcagaaatggcaaggcaaggcaaaattgttaagacaaccggcattagtcagcgaattgtgccattatcaaaggcagcttttgtacctgagagccagaagttggcgcaagatactgaactcatttcagttattcgccaacgaacattggacgacgagccttttttagtggaacattcttattacttgaaatcaatggtaggcgaaattccggatagcgcactaaaaggttcgttatttgcttttatcgatcaaaagccaggactaaaagtaggtttcattgattctgtcattgaatgtgaaatgataaccggcacaccggcgcggttttttaacctagcagatggcagtccgagtttagtggttcgtgatgattcgtatcttagctccggaaaattatttgcgttttcaaaaatattttatgatttccgaaaaactaaattctttatgcttaagaagatgcactagtttttatataacatcgaaagttaaaaacgagacgcgctcaaattgacgaggcgtctcgttttgatgtttactttaaaaaatcgagttacccagcagtgccataacataagtgaataatgccgcagcgttgaccagcatagatactacaatgatcgtgaagcggaccgtgtacggccgcgttccggttgacgcattaaaaaaccgggagtgtcgctgaccgcgataagcaaaagtaaaaccgattaaaagaacaacaatgacactctccacaatcgcaagcagtaagaagatcggtgggtttgggttggcggtcacgagaaaataactaccaaatgcaatcaaatcaaggagcaaagaaatcagaaccattagcatacctccgttgtcaatggtgagtggcgtcggtaagtatcattattcgggaaagaagagcgtcaagcaagtaaaagcgccgggaatagcctgaacaaagtaaattttcttactcatcgttgcaccgccgtataaaccgacaatggccacaaagccggttagtaaacgaagcgtgatcagttgattcgggccatttaacagcaaaagacttagtagcatgacaacggccagcgcaccattgtaaatgccctgattcttcaacagcatttgtgcatgcggttgtttaacaaagtcaagcggtaatgccagattttgcgcctgactcgttggtttgccgaacatttctaaagccatgatggtgagatgcagcagactgagcaagccaacaagcaggaaactgatacgtgacatcgggaaaatcctttcttgggatctattagctcagatcgacattaaataaacggtcgaaattgtgctagtgcaaagccgacaaccgtgacgagcacgaacgctgcaatggcactccagatgatgattttactcagatgctgctgctttttgtcggcaaacgccatttcgagcaaaccgatcaagccaatggcaatcagaatcttgatgaccgttaacatgggattgcggttgaaagcaaaccgcattaagaccacgccgctgatgatggagacgaggtaacaaacccgcgcaatcatcgtccacatgacaaattgacgagtacgactaaaaagcgcaatgccggcagcaactgccaagacggcccatgaaatcagatgtaaccacagccacataaaaataccccctttttctgaaatcaaaagtactagtcccactataccgctttccgaaaagacgtgcgatagccagtgaaaattagtaaaacacgaacattaaacacaactatttgaaaaataaacgtattttctattgcaagttgcgacattcttcggtaaacttttcatattcaagttaggggagcgtgtcatggaaaacttttttcatttaaagcagaataagaccacgccgatgacagaagtcatggcggggcttacaacattttttgcaatgtcatatattttattcgttaacccgcaagttttgtcacaaaccggcatgccggctcaggcggtgttcttggcaacgatcattgccagtgcggttggtactttggttatggggttgtttgctaacgtgccgtacgctttggcaccgggcatgggcctcaatgctttcttcacttacacggttgtcttcgcgcttggttttagctggcaagaggcgttggcactggtgttcatctgtggtgtcattaacattttgattacggtcaccaagattcgaaaattgatcatcgttgcgattccggaagccattcaacacgcgattggcggcgggatcggtgttttcgttgcttatatcgggatcaagaacgctggctttttacagtttacgtccgaagcatctagcattaataccatcaacggccagccgcttaaggaaggtgcattgaccctcaagcacgggattgaatccgtggtttcaaacggcggcattgttccggcgctggttaacttcacccaagccggtgccgtgttagccttgatcggtttggtcatcatggtgatcttgaacgttaaaaaggtgcctggtgctattttgatcgggatcttattaaccacgattatcgggattccgatgggcgtgacagatttacatctcagtgccgccaactcgtttggaagcacatttgcctcactacagacaacttttggcgctgctttttctgctaaagggatggggtcattgttcgccaatccagataaaatcgtcctttcaatcatgacgatttttgcctttagtttctcggatatttttgacacgttgggcacctttatcggaaccggccgacgcacgggtattttctcggacgctgacgaacaggcgttggaacaaggatcaggtttctcatccaaaatggatcgggcgttgtttgctgattccatcgcgaccggggttggttctatctttggtaccagtaacgtcaccacttatgttgaaagtgccgctgggatcggtgctggtggccgaaccggtttgacttccgttgtcgttgccggtatgttcctgctcagttcagtctttgcgccattcatcgccattgtgccgacccaagcactggcaccagctttgatcttagttggtatcatgatgatgagcacctttaaggaaattgaatgggatgacttgtcccaagcgatcccggccttcatggcatcaattgtgatgggctttgtttacaacatctcatatgggatcgccgcgggcttcatcttctactgcctgatcaagctgatcacgggcaaggtgaaggaaatccatccggtcttagccattgtgacaattggcttcatcttgaactttgtcatcttggcatcactttaatccaaagcttaaatagacttttaaaagaagccgaaacagccaccgttacttactgagtgaataagtaaggcgagctgcttcggcttcttttttagttgggtgacttgtagtatcctcatgctgaggtgatagacaatggctttaaaaacaatttttcatttggacacaacccaacgctgggcgcacttggcttcaaatctcaacaattatctaggcgctgaacccgacactgacatcgaagtactggtgaatggagacggcatcaccgtttactttgacgcgcaagtgacggagttcattgcggcgcacccacaggtaaaattctttgcttgccacaattcacttcagcagcgtcatttagacgaacggcaattaccggcaaccgttcaagtcgtgccagttggtgtggttaaactggcacaagcggaagcggctggatatgggtatattaagccgtaatcaataaaggctgatagggtcgttaaaatcgtgaggggatttttgcaaccttataggaacgcggaggaatttcacgatgaaaaagactattgttctatgtgcttttcaaccggtgctggaactggacttgtaaataaactagaatcctactataaaagtcaacgtatttacacacgctttgctgattttgtaggtactcgtttcagaggttccttggacacattgcctggaacgacagtcgagtatttgacaggtggtaattctgcaatggctgctgccagaacactctttgctgtgaaatttagaattcctgatttaacctatgactcagctggtatcgcaaaggcatttaaggaattaattgatggacatatggagcgatcataaaattggaataggtgctttgtttttgattcttgtacttgcaaaccaaactttgttgtgtacatggcagggtataggattacttgttctagggattatcctgttgtttgtgggggctttttcagatgagcacagcttttggcccaaggtagcatttacattggttatggcagctctcttcttacagacacatcaatatgctggttactcaacaatgcgtattgttagtcatggacagactctccaagtctttgcccaaaagagcacgtatggagaaacaacatacatgttcgaggtttatgagaaagggagctttctctatcgcaaggtgaataagaacacgattcaatatgtcaccgcgtctaatacaagttcaagacaagtcttcaaaatcgtatggccaaaattacgaaaagaatagcgtaataatgatttagttcgttactgagtatctaacgtagatctcagataggatagttgcatggtttgctggtagtcttattttaagattccggacttggataggttaaagttatttgtcccaagtgtttggggggcatgattgaataccacatgaaatgatcaaggagagtggtttagaagagactttttgatgagactgcataggtcctaaacaaaaaatctacctcatttttagaaaattgagattgcgctataagtagtttcaaataacaagcgccgccgctgagaactgaaaaagttcatggtgacgatgcttgttttcttgttaataaaaaatgacccgccattaggccgcaaacgttcaattgcaaggtacacttaaaacggcttcgataacccttatgctttaaggaatactgaagccgttggttttttagccttttcttatcgtaaacagttggcttgaacttttgtgaatacaagactagtttgctaacgatcccagttagctaatcccattcaacaattcctgacgcagatttgcgtaagcagggtcggcataggcaacatctggtgctagttggaagaaaggatttttgtaggtggctttgatgatgccggggtgcccgttcatcacaacgatccgctggccgagaaacaacgcttcgtcaagatcatgcgtaatgattatcacagcattttgagttgcctgccataagtcaaacaacagggcgtgcatatcggcacgagtgtgattgtccagtgcactaaatgattcatctagcatgagtaagggtggctggttaataaaggcgcgggcgagagcaactcgttgttttaggccgccggaaaggtcatagataggctgattggcgaaatggcgcagtccggcgcggtcaaggagagctggtagattgtcagctgattggtaacgcattttaggaccgaatagaatattgtcgcggacatttaaccacggataaagtgccattgattgaaagacgacaccgcgttcccatgacgggcctgcgatagggatgccgttcatggttaaggttccttgactaggtggcaggtagccggcaatcagatttagcaaggtcgttttaccaatgccggaaggaccgacaatgacggtggtcgaatttgatgcaatgtttaagttaatattgtggacagttggtaagcgctcattttggtaacaataagctacatgatcaagtgtcagtaatgacatgattgccccctagttgagatatcgcggtgtaatgaaacgatcgcagtctttttgactcactggtttggttaatgtttgttggcgccacataaattgtgccgtttcgaaaaattgcgcgcgaaattgtcgcgtcataaatgttcgttgggattgatcggatagccattgagaggtgccaatctgtttcttaacggtggcaaccggtagcgaaaggctcttggcggccgttcgatagatgctttgaggaagatcttgatactggctgtggatcttgtttaaagttgccaataacgttcgaagcacatctggctgtgttcttatgaaagcatctgttgctagggtcacattggcggttaggtgaccggtttgcgccatttgacgactatcaatcagctgtttgttgcccaataatgccgagaggctgggttcccaagtataagcaccatcaatatcaccacgctgccaagccgccacgatttctggtgtttgcatgtcaagcacctcaacctgattggttaagtggtgctgctggagtagcatcatcaagctataatgcgatgttgaggcaaacggggtcgcgattttcttatgcttgagttgtccccatgtgtcgattccggctttttggcgaattaccaaggcctcgttactgccgatgatgtcgttaatccacactagtttagcggaaataccggcagccagtgcaaccacggcattggtgtgccccatggttgccaactgaacatcattggcgatcaaggctttgttggcatctaccccagagtcgaaggcaatgaactgaacggttagcccttttgcttgacaggctttctgcagtaggtgacgctgacgggccacggccacatcgttaggaacccgaaggacgccgattttaatggtccccgctgatgtaggtgtggcgtgacaactgctgagcccaagcaaggagcagatgagaagcaacacccacagccataggcgatgatggtttgtcatgatgcccagtcaactccttccttgccatttgatgaaatgctgaccgaatcgcttgagtaaccagtctagtaacacgccggtaaggcccatgacaatgatatcgactatcatgacatcacttttaagataatgcgaagcgtcgatgaccatccacccaatgccactggttgaggcgatcatttcagctgatacaatcgttgtataagccatcccgacagcagaacggataccggtcataataccgggcagtgcggctggaaatacgatacgggtaaagatttgccgagaattagcgcctagcgaggcggcattatgccgatagtcaagattaatacttgacactgcatcgtatgcggctaagtaaataggtggtagtgcagcgagaaacaagagtaagatttttgaagattcaccaatgccaagccataaaataagtaaggtatagtatgccaatggcggaatcgggcgaagaaactgaatgatcgggtcgataaactgcccggttttcacatgataagcgcttagtaagccaagtggtgtgccgctcatgacggctaggacaactgcaactgttacccgtctcaatgttagtaaataatgttcccaaaaaggcgtcccattgtatccgaactgcaagagattcaccgctgctagccaaactcgtcccggcgaaggcaaaagaactggggacactaaatgaagccgcgtggcaagccaccataggctcaagataactgctggtatcaatagccacccaaaatggcgggatagtcgatgtttgatggtcatgatgggatcctccgttggcaaaaggctgaaaaccacaaatgtctagaccacccaggcctagacatttgtggttgatctaaaaacctagagcaggtcgaagcgatagttcgtcacaattggtttccgattctgagtcgtgtcttcgaaatattcgaattcacagagatccaagaaggaacccgcaatgttgtaaatattatggtaacctttattgccaagcgctcgggcaacgttgtaacttctttgaccactcaagcaatggatataaaccggttggtctctgggaatctcatcaagatgttcgcgaaaacgactcatcggaatgtttttggcagagatgatgtgaccttctgcaaattcatcaggctcccgcacgtcaatcagcatcgcgccagcttcgactaacggacgaacttgtgaaaccatgatttgtttaaattcgccgtttaagatattcgtggccaccagtccagccatattcactgcattctttgcggtgctaaaagttggttgatagcatagttccaaggtctcaagatcctcaacataattgtgattggtgatggcggtagcaataatatcaatctgcttatcaacaccgctttcaccgatagcttgtgcgccgagaatttcacctgatggatacgcgaagatcaatttcagatagagcggtttagcgcccggtataagtgccactttatctttagggatcacaagggcttcccgatagtcaattttggcatcttggcattggcgggcagttaaaccggtggaagccacattcatgttgaagactggcaaacactgggatccaatcacgccacgattgcggatttgacgaccgaaggcatgatcgacggcttgccgcgcctgtagttgtgctgggaaggctagattgaggcgtgttggttgccgtaagagacgttgataaacttcaatggcatcacccacagcataaacatgcggcaaatttgtttgaaaggcttgattaacttgaatattgccggttttgcccaacttgatcccgctttgttgagccaactccgtatccgctttaacgccaatcgccatgatgacgatatctgtcggtaattccttaccagaagctaaagtaatgtggtcattctcaattgctgttaatgtgtcgtgaacgattaaccgaacatcgttatcgagcattgttttttggacaagttgtgccatatcttgatcaatggtggccagaatgtggtccgcgccttcgattaaattgacatggtaaccacctttaaccagattttctgccgcttcaatgccgataaaaccgccgccgatgacggaaacattagttgctttgcgatctttaagcgcagtagccaaggctttaatgtcgtcaacattgcgaattgtgaagacattggtgttctgaatgccgtgaatggatcgcggcagaatcggtacggcgcctggggacaggaaaagatcatcatatgaatcggttgtcacttccccagtacgaacatccttgacggtcaccgtttgtgtctcagcgtgaatggctgttacctcatgattgacgatcgcatcaatattatattgttgcttaaattgttcagaatccatcaaaacgatactttccgcgtccggaatcatgccagataggtgatagggcagcgcacaatttgaaaatgagacattcgggcccttttcatacatcgtaatttgtgcagattcatccaatctacgtgcgcgtgccgcgacagatgcaccaccggcgacgccaccgataacaataatctttttactcatgttgcatatcctccttgagaagtttatttggtagataggttgggcaaagcgctaatttaccttggaatagtttgatagcaaaagcagcccctaagatcaagaaaagcataaagatataaccgtgtaacgaaaagttggtgatagatgagtaaagcgcgccaatgttgcagccgcgtgccattcgagagcctagacccatgagtgcaccaccaagagcatagccgctaaaatctgccaacgacattttgagattggctttgaaccgacctgccagcaagaaagcgatgagtgccccagcaacaataccaatgttgcgaacagttccgccgtctgcccacaggggaccgctcatggcctttgcggtttcgtcaaaagccggtgaagtgaaatgcatcccgaacaactgcaggaatttttgatccagtgtgacaaatggggtggtgacgccccatgctttattagtggtaatcataatgaagctggcagcaagtgtgagtccaattcctccagccaaaaatgaccagcgctcaatgaataatttgtgatacgtttcccatgaaagccatttgagaggcgcggtgtcgttgacaggcagcggcttttcgtagtcagcccaatccgattggggatgtaaccaggcaccggacgcttttttcttgttctcataggacttcgttagcatataaagcccaaatagtagcgcaatcgtgagaaggatggcgccccaataaccaatatattggggtagccacacgttaattccaattttgccaatggcagtattgtcaagcacgtaaccgaagtattgccctggtgcggcaaaaagaatgaagaatgggaaggcaatccaggcatgaccctcaccttcaccaaaatcggataaggttccggaagcgcaaccgccagccatgatcatgcccattccgaagagaaaagctcccagcatgacggaaatatttccgattcgaacgttttgggtgccagggatcagcgcttgattggcattggtaatctcccaagcgggtactgcacctttactagcagcaaaccactgaatgccaaagttgatgagtgctgtggtcaaaagcatcactagtagcgccaccgttaaactgctttcgccacgataaaagatacgcttgacgccgccggcaaaaccgaatctggaacgtgtcagtatataaccgatcattaggccggcaaataaggctattggcagtgaagctgatgatcgttgtagaaaaatagcccacacacctgttaatatcagcacaatcaggccgataaatggttgatgtttattcagcccatagcgatcgaacccttttgatatcatggaaaccccccgatctttttacaattaaaatgtatattatttcacaatttaattgaaatacttattcaggtcctttaatataacctgtagggtatggcgttattttgggggatgatttagtgaaggacacaacacagtttcttacctacttgcgaacgattatttcaactggcagcgtgacggcggcagcgaagcgcttgtatatttcgcagccatacttgagcaggaccattagtgaacatgaacgtcgcttgggttatcgcttgctggatcgcgataaacgaccaatcgccttaactgcgattggcgtgcaatatgttcgcaccttggaacaattaaataatcaatataataagctgatgcatgatttagaaaaaatggcagatgtcagccacttacggttaggcattaatcagtcaatgtcgacaattgtggcacccccgctactgtatcgatatcatcaggttcatccagaaagtcagattgcgtttactgaaggtatttccagcgaattgggcgatttactgttatcggggcgaattgacgcgcaattgcgattaatgccgattttttcgaatgaaattacttattatccggtttgtgaactgccagtttatttattagtcaatgacagttcatcgcttttcacacccggccgacgggaaattttgacgctgccggtcaaagctgctcaattcgatcaactagcatatatcacgttggattcaggttcgggattcatgagacagctaagtgtctttttgacgaacaaaagattcatccaaggacggcttttaacgtgcggttcattcaaactgccgctaatcttgcgtatcagggcttgggatgcacatttgtgccgcaatactgtcttcgccgccagtttgatgcgtctcaatgtaatattatcaaggtacccatggagcaattgtccgttaagattgttcttgcatatcgcagggattccggactggcgagcaaagtacaacagttaattgatgaaacagagttaccgacgttgcttcaggaactttgtcaggattaaagtgtgatcgctaccgtctgagaagcgctggaaaagcagatttcaagcgctgctgttagattagttcaatgaaaaccacgcaaaaagcacccacgatcaaaatattcgcgagtgcttctttcgagttctgacataattggaggagcgggaatgcgcgtggtgatctaagatttctccacggcctgcagcggttctgtattaaacggaaccaactgccgctcgattgcttcacgctggtcttccaagaacggtggcagttccaaatgcacgccggcttcttcgtaagtctcgtcaagtaggaagccagggccatccgtggcgatttcaaaaaggatgtcggaaattggtcggaagtactctgaagcaaagtagaagcgatccacaaagccagaagaattcaaaccagcattcccgattttctcaatccagtattgcaggctatcacggtcgtcagtgcggaaggcaaggtggtggacgccaccaaagccttgataagctgcgggtatcaaccgctgataatcgatgatgacttgcgcaccgtggccgccgttgttcagttcaagcaaggtgtgttgaccgtccttggcgatttgtttaaagccgagcagatcggtcatgacactgattaactcatcatagtgatcagtcgtgatgtactcaggaccaagaccgccgattgcaaattgtgggtcaaccgtcgaatgtcgccaaggggttcccgctggcacgccttcattgtgttcgtcactgatcagctgatattgctggccatcaaaatcatgaaaacggagaatcttggcgccaaatagttcgtcaatcgcatcatggcgcacgcggtgatcatcaaatcgtttgatccaatacgttaatgcagcatcagaagggacccgaaaactagtgcgggcgatttcgttgttgccgtgttgtgctttttgaatgccgggaaaatcaaagaaagtaatatccgttcccgcagttcccatgtcatcggtgaaataaaggtgataggtacgaacatcgtcttgattgacggtttttttaatcaggtgcaagcctaaaataccactcatgaaccgaaaaattcgtggtgagctcgatgtaattgcggttagatgatgaagaccggtgagttgattagccatttcgtatccctctcttgcttacatttagtaagtaaaagataacatggctcaccttgaaaaacaagctttgcgttttggttaaaatcattaaggtcttatcaaaatgcccgttttcggccaagttgctgggcgatcgcgtgatatgctcatttcaatcatataagtggatggcaaaaaggagcgcatggcgatgttcaattttcaggataatccggatgagtataaacggttaatgcagcttgaagttttgattgcgattgtggccatcgcggcgagcatcgtgatgttcagttttggggtcatgaccggcgctttgtttgcggcaattgctggggcctttttccttatggatgccattgttgagggccttcgtttgctaggagcatcgcgcggttttagccggttcattggtacggcaattgcgattcctgctttggctggttatttgatcatgatgttcaatcgattcccgttgcaagtggcttaatcaaagttatttggctaccacgctgtcagttagcggatccggtaacaccgaaaccatgacgtattttaatcgcatttgaaaataggcccctgagataacacggttaagctgtgttttctcaggggcctattttgtttgggtatgagtaggggtcacctataagtcggccggtctaaaaatggaagtcttccttatccgcaacatcttcggcggtcaattcatagcgaaccagtggaactttgctgccgtctggtaaggtccggtcatgatgataatcgccgactttggtaaagaagttggtggtcaataacttggcgccgcgttcattggtcgcaggcaagatgacataaacccgcttcaacccaagctcaaaaaaggcaaagcccagcatccgtttgatcacttcactcataatgccttcgccttgatggctggcaagcgtttcaaagcgtacttgcgccacggttttcttttggctgaaattccagatacagaaactgccaaggaattcgtggctggcgcgatccatgatgccataaagtaaggcgttgttgctcattaccagccgcatcgaacggttaatgtagcgggcagtgtctgtaattttttgatcaaattcgcgtccggattcggcagcaacttggcggtcggcgcgcaactggaaaatgtctttgatcttaaaggttgtcagccaatccatggtgtaatggacggacataatcggatggtatttttcaaagctttgcatgataggagcctccgtaaacatgatgttaagtatgcgtcagcccaatttaaagcaggcgtgtgagttgcaacttccagtatcgtgacgcatctaggtcatggtactcatcgtttcctgcttaggcgtttgggactgagaacacttgctggagttagcttaacataaaaaccgccaatacactgatttgaaaaccattcgcaatttggtacggaccaaaaggctaaagtcaagtcccgatcttaattaaaaaacacttgagcagacgtatgttatcaagatgtggtagcgaaaacttggagattttcaactaatagcgggctttcttggcctgtatggacgcggtttgtttaccgtcttaaaaaggatttttttatttttttagcaggcaaataaaaactgaaaatgacaacatatagttttagcttatataatcataaacatcgcaaagggggtgagtaatttgaaacagcttttttttggctcatgtcggggttaatgctgctacaaccggttgggttaaacgtggggcaacaagttgaatcggcgctggcgagtcaaccgacaacatctggtcagccatcagtagcaaccagctcgtcatcggtagctagtcgcgaaagtttacaaacaccgagcgcggcatcggctgcaagtgaatcagcggcaacgcaggcatcggtgccagcagtggtcggcaagaaacagcaaccaaccagcaccacaacgccagccgaatcaaccacgctgaaacgatccaagcgggccacttcgccagagtcaagtaatcaaccgcaaccgtgcttggttcaaaccgccaaagcattagccgaagcggtacggcgaggcgaaacgtatatccgcttgactgctgacattaacatcggtcgcgcggcgattccggtcaagcattcactcgtgattgatggtgatcacaaatacacttatatgtacaacggtggcgaaaactggcatgtcggtttgtactttgccgccagtaatatcagtatcacgttcaagaatctgaaaatcggtgatccgcgcgtcaagaactctgccaacaattattacggcattgcaccagcggagaacctcattaagaacagtaagattattgtcgaaaatgttgattactattctgatcgcggggcccagccgttccacattcgcaacgcaagcaaccaaatcgtcttcagagggaaaaattcatttcataccactaaaattgctggatcggttttagttcaggaatttgctgaagcgactaactttctttttgaagaagattcggataccacgattaatatggaaaatacagagctaatcggtactttctggccatcaaccggcccgctgaacctaaccctgaaaaatcgggcgcgactcaaagtggttagcgccaatgcactggtttattcagatggcggggcgttgcacaagaatcgcataacagttggggaaggcgcggtcttagacgttaagctcacagacaaaaaagatggcgtgctaatgtaccatgaccacgatttaaccattgatgtccaaaaaaatggccgttttctagccgaaacagttggagcaaacaactttaacaagaattccagcctgaatttagggccgggtgccaaagccgaattgaaaaacactcacggcgatttctataaaaatggcagtgggacgattcgactcgacaacgctgacgaattgctgatgacctcgggaagccatggtaaaaccagtccaaccgggttgtcagcatcgaaaccaacgttaacatttgcccctttttccactgatacaaaaggatatggcatttatgccgatgatcaatgggtcactgatcaagctgatacatcatcgtgggcatttacgccatcccggatcaaacgcagcccaactgctttgacgagagggcaggaacaccagattcaggcggcatcacgctttaaggtggttcgtaatgcaactaaaggcaccaccgaaagccctaagaatccgccagtcgtcacaccagctaaaaaacccggtcagctgcttttgaaacaagtaccggattttgattttggaccccgtctgatcaagccggagacccagatcctaaggcccaaagttgatggtgaattcattattgaagacactcgaacggcggcagctaagtcagtcaaagtctatgtcaaagttataaagccgtttaaaaatggcaatctcgatgtgaccagttgtctaagctacatcaaccgctcaggcacggaacaacagctttctgatcaagctgttttggcagaagagatagacatgacgtcaccgcagtcgttaagcagtcagtggaatcaggccactgacgagcaggctcgtgggctcaagttagtgttgccagtcgagaagcaaaagttgggaacttttacaggtgagtttgaatggtcagttcaagatgtgccgaccaattaagagggtggttccaagtgatgaaaaagtggctactgctggtagttttgctaatcggttttacttgtccaccatcgcaagcgctagcagtcgagacacaaacatccggtgaaattagcttttttgaagttgagcagccggttaatcaaccgtcaccagaacagatcaagccaaagcaacaggtgaacgtaccaccaccaaccaaagaagaccagctaccagccttgggaatgatgaccccactgcttgtgagtttaatcgggctactactggtgttgctgatgctactgattttgctgacaaaacaatctaacacaaacaagaaagaggaagaataaacatgaaaaagttttacgtgatggcatcaatgcttggattaggtatgttgggtttggctggagtaacaccgacactggtttctgctagtgatgtgacttcaaatggccaggttaagtttaagttggatcaaagccaaactgacccgaaaaacccattagatcccgctgataagaacccaggcaagccgaccgatcctactcatcctggtggcaaagttccgggtggcaccgggggcccgttgtcgatcgactttgcttcaagtctcatttttggagaagctgaaattagtcatgaagatgcaacgtattacgcaaaaccgcaaactttcacacaagacgatggcacaaccgttgaccgcccgaactttatccaggtgaccgacaagcgcggcacatttgaaggttggacgttaaaagtgaagcaggaaaaccaatttgcggttaaagacgatccgaccaaggaattgaccggcgcccaactgagctttacaaatggtaacttggtttcaagcaccgacgcacaatatgcaccgaagttccagaagtcatttgatctcattccgggccaggcacaaattgcgccagttgaagcggctgctgatcaagggatgggcacctggatctaccggttcggcgatgataaggagatggccaagtcaattgcgttgtcagtgccaggcaagaccccgaaaatggctaaagcctacacgactgctttaacctggtcattggaatcaacaccagcgaataccacaagtaccccaagcactacaagcacgccaagtacaacgggtaccaccaaaccttaaaaagctggaacgacactgatgatttttggctagcatcaacggtttgctaacggacttgaaacattcaaactcattggagaaggatacgatgacggcactaggccgcatcgttgggggaacttaatcaaaaggagatactttgtgaagaaaaaacttttctgcttcataacgcttattgtgatgttgatcatgcctgccactcaagtttttgcttcggaattaaactttgctgctaaagccgagttaccggacaatcaagtgaatcctgatgttagctattttgacatcaaaatgaatcctggcgcgcagcaaacgttacatgttcagttgcgtaatgaaaccgaaaagccagtgacactcgatgtcgagcttgccagtgccaccacgaatctcaatggcgtggtggaatatacacccaacacgattaagccggcaaagagtttgcaattcaacatgaaggattatgttaaagcgcccaagcaaaccgttattccagctaagggcagtaccgttttggatttagctgttaagatgccggataaaagttttaatggcgtcatggctgggggaattacccttaaagaacatggcttgagtgatcaaggtggccaagcatcaggcaaaaaggttgcgatcaaaaatcgcttttcctatgtcatcgggctcctgatgcgccaaaacttagccgctgttccagctcacgttaaattgaatgcggttaagccaagtcaggttaatgcacgcaatgtcattttaacttcgatggaaaatgatacggcaaccttcattcagcaagtagccgtggatgcaaagatctttgctaaaggttctaaccaggcactttaccaagttgccaaagaagggctgcagattgcgccagatacgaactttgattttccaattgcgttggcggggaaagcattaaagccgggaacgtatgtggctaaactcgaagtctatggtaatcggcagccaaacggaaagatcttacgcacaacggcagaaggtaagcagcattaccgggatcactggaccatgaccaaacaatttaccattaccgaaaaagcggcttcaacgttaaatcagcgggatgtgacgatcaagccaagccatccgcagtggacgtacattctgattggtgctgtgatcgtcctcatggcactgatcatcctgctactgattttgctactgcggcgtcaggctaagaaacaagcttcttaatcaaaattgtctgagcaaggtgtttgcaagttttgaaaactggcggcatcatggacacaaataaaggactctgagaattcgtgaacgataccgatccagaagaaatgatgatatctgaaaattcgcgcctttggttatcagcaatgtttgctgctgatggcaaaagtgggcggatttttgccgtgagttcccaaagccgggtgagttatcgttggcggcgtttgaacttagccaatttagcgtatcggcttgccggaaaaacattgttggctcaatcgaggatagaacgtgctaaaaagtaaggtggatcttgtgaaattagttgaactgatggaaaaaaacgaccaaaagaagcttcagttactcaattatcttgatcaatatccgaatcgtcaggtaagaaacagcgagttacaggataaactacaaatttcctactatatgtttaagcgatggacaaaagaaattgtggacgatattgctacttttcaactggatgatcgttttagtcttgaagtgacggatgcatcaacgatcttgcatgagcaccataataccaatacttcggtctttttggcgcactatctgaaactgtcaccaaaagtcaatatcctgctgacgctgatgacccaacaagccacgtttaacttagcggactttgccgaggcgaactatgtgagttacacgtttatgtataaacgctatattgcgctgcgggagacattgaaaaagtggcagattactttgacgagccaaggcgagctgacgggcaatgaactcgcgatccggctgctattggccaaaatcatggtggtcacacatgtcactgaagataagtttaatcatgaggttcggctggccttagccgaattgctgggcctcatgaaaacaaccgatgccaagccgtcaatgagccaactgattgaaaccaaggcttatgtgctaattagtttgctccgctgtcaacagggctatacaattgcgagttcccaagaagtggctgatttggtggccaatattcgtcaaggtaccttggcaaccagaaacaaagcgattgcgatctatcaggctcattttgacgccagcgatcaggcaattaacagcgaatgtgactatttagggacatttttggcgattcttggcattattaattccgaggaaatcgtttttccggagacaattaagcagcgcgggcaagcttttatccacggatttgaagtcaagtttaaagtgacattatccgccgttgctaagctgaagattgcgtatgcagtcaataaatgttttgtagatgttttggtattaccgtttcgcagcgagtttttcgatgatcatatcgacattagctacttctttaaaacttacccgggattttttgagtattgtcagcattttgttttaaaccaggccttgcacttggaaagctcacaggcacagtttttgttttaccattgtttgttggcactcgccgccaatgttccgttgagcaaggtattagcaccattatcgatttgcgttgactttacatccggtcacgactacaacgctattattacgcgggatattcagtcattttcaactttgaacattcagatgacccagcaagttgaaccggaaacacaactgattattaccgacttggtgaatgcttatcatgattacgatattccaaaagtgatatggctttctccgccgcggcctgaggattgggaaaatttaattaatgaattactgcgattacgcgagcaggcacaagaagaattccaaaaacgctagaaatttttcgttgcttttttgcaacgaagaattagttgtgaaaatagtgtaaatggactagccacactggattaagcgcctttggataacaacggttattcaaaggcgcttctttttatttaactcaaaacattttgatattaataaatgtaatggtatactcgccctattcaaaaacggaggcgagacaccatggaaaaggaaacaggtttttggccggcgattaaagactttttctttcgtgccggtgattttaaaggcgttagttcacgctcacagtattggtgggtatttctaggacaattcttgttaggcattgtcattggcttggtatctgtgtcgttaggtgcgacattctcggcgaaaacgcaatcttttggcagcagcatgataagatcactcttgacaacattagtcgcggtccctatgtatctaagctacccgcaactgagtctaacgcttcggcggttccgagatgctaaggttaacccatggtggtaccttgtgctggtaatcgttgcattggtcggaccattgctgacggccaacggtatgggcttgttgccaatgatcatcttgccgcttattgttgcactggtaacactcattatccttctattacctagtcgtgaacagaccgtgaagccttttccagctcacccgcatacaggtagtaccactggtgtaggttttggagcggcagtcaaagatctattccttcgtggtggcgactttaccgggacatcgagtcgtagtcagtactggtggagtatcctattttcagcgttgatctttgtgccaacgttcttctttctcgtcttttcgatcactgcagcgctccttggcagcgctgcattaggcaaaatgcaaccgcagaatatcattaatatgattaattcattgggtattggtgccgtgattttggtggcgattatctttgctgttctctatggttggtcgatggtagctttgccaatgttaacggtcacttggcggcgtttcaaggatgcaggtgtcagtccatggtggttcatagctcttaacattgcgtcaagtatcgtctcggcagtacaaggaagtgtcccaaatgtcccattaaacctggtaacactcattcttcttattgcgcaaatcgtcatccttgctttaccacctaaagttcaaaatgacgaagcataaagtaatctgtaccacgcaaaaagtgcaaccttccgcagcggaggattgcactttttaatttgcgcttttagttgcagggtgaatcaataaatacctttttcgtcttcatcaaccagtggatcattaaagtttttgtggaagtacgtgctgtcgatgactttaaacttgccattcgcaaagcgggcaatgatttcgccgtattgaacgatgagtggttcggtattgggaatttcgattttcaggcggccaataggcgttttggtaaggtattgaaaattgtcgccgaagaagccttttaggtcttttgtattggtgtcgtgtgaatacggtaagaaatgggtcattttggccgttgaaaatgccgcaaattcgccttttgggaatccttccaaagatgaaggttgagccatggtattctcctcctaagctaagcgtgagccggtgggcgcgttcatgtgtggggatccaaaacgcatggatcgacttgggcattatatctcaagtctttccacacaggtttatgcgccaatgaacacgtgatgtttgagcgcgttataatgcccggagaggttgtttggacaacatcgcgagtttatgaatttacttatcattatgttaacacaataatagaacaatggaatgattgcgtcgcggcctgaaaacgcttaaaattgaggctggacgttgatcggaggtgagcatatggatcaaagtctgtttcaaaatggtaactttcagccgttagcaagtcgtatgcggccgcaaacgcttgatgagtttgtcggccaaacgcacttgttaggaaaaaacaaggtgttgagtaacctcatcgaacatgatgagattagttccatgattttctggggtccgcctggggttggtaaaaccacattggcgcgaattattgcccggcgaacgcaggcacagtttgtcacattttctgccgtcaccagcgggattaaagaaatcaagcaggtgatgaaagaagctgaacaaaatcgtgaattgggtcaaaagacgattgtgtttgtggatgagattcaccggtttaataaagctcaacaggatgcgtttttgccgtatgttgagcggggcagcattattttaatcggtgccactaccgagaatccatcgtttgaggtgaatgccgcgttactttcacgtactcgggtttttgtgcttcacggcttgacgagtgccgagctggttgatttattgcagcgggcgcttaaggatcctcgtggttatgggctgcagcaagtcaaaattagcaagaagttattagcacagattgctgattttgccaatggcgatgcccgcattgcgttgaatacgctggaaatggcggtcaccaatgctgagacgaagcatgacgtggtttcagtaacgcaggctgatgttgctcagttgttgactaagaaagccttattgtatgacaagaatggcgaagagcactataatttgatttcagcattacacaaatcaatgcgcaactcggatgtggatgcagctatttattggctggcgcgaatgttagaagctggtgaagatcccttatacatcgcgcggcggctcgttcggtttgccagtgaggatgtcggaatggcggattcgcgggcgttagagattgcggtcacggtttatcaagcgtgccagtttatcggcatgcccgagtgcaccgtccatctgacgcatgcggttacttacctctcacttgcaccaaagtcgaatgcgctttacacggcatatggtgctgctaaaaaggacgcaactgaaaccttggctgaaccggttccgcttcaaatacgtaatggggtaacggatttgatgcaggatttaggttatggaaaagattaccaatatgctcacaacacaaaagataaactgacaactatgcaaaccatgccggataatctcatcggcaaaacgtactatcatcccaccgaccaaggcagtgaagctaaggttaaagagcggcttgaacaaattaaagcgtggcatgcacaacacccagcccctgaaccgccacggcctaagaaaaagtcgtgagtgggacgctgctagtgggcgttaacactatcgtcaacttgtaacagttcaatgtgctgatgcagagttgaatcatcatgcgttattcggcggtgaggacttctaagcgcgccggctcacgctcatcttaacgcgttcgccggcgcagggatctgcgtgtaaggaccttggtcgcaatggccaaagagcggccatcacgcccaaggccgcttacactccgatccctaagcgcgccggctcacgctcatcataacgcgttcgccagcccagaaacctgcgtgtaaggaccttagccgcaatggccaaagagcggccatcacggctaaggccgcttacactccggtttctaaccgggctggctcacgctcaccataacgcgttcgccggcgcagaagtctgcgtgtaaggacctcagccgcaatggccaagaccgggccatcacgtctgaggccacttacactccgacttctaatcgcgccggctcacgctcacttgtttaaaattaggaggaataaaataatggcaaagattctcgcagtcaatgcaggtagttcgaccctgaagtggaagctttttgatatgccggctgaagtgcagttggctgaggggttggtcgatcgattgggccagccgcaatcgaaggttaaaattaaatatggcgacggtcagaagtacgagagcgataccccaattgcaaactatcaagaagcagttgccagcttgatgggtaatattaaggcgctagggttagtggagcatttgcacgagattatcggggtcggccatcgagtggttgctggcggcgaaatttttgccgaatcagttgttgttgatgatgagacgttgctgcagattcagaatctgcgcgactatgcaccgttgcataatcccgttgaagcggactatatttcggtttttcggaaaatgatgccttgggcgaatgaagtggcagtttttgacacggctttccaccaaacaatgcaaccggagaactttttatatagcattccatacgaatattatgagcaatatggtgcgcggaagtatggtgcgcatggaacaagtgtccgttatgtgagcgctcgtgctgctgaaatgttgggcaagccgctagaagatctacgtatgattgtcatgcacttagggtctggctctagcatcaccgcggttcaaggcggacagtcaattgatacgtccatgggctttacgccattagcaggtgtcaccatgggcacgcgatcaggtgatattgatccgtcattggtaggctatctcatgaagaagttggcgataccggatgttggccaaatgattcatattctcaacaacgattccggtctgctaggtatctccggactcagcaatgatatgcgtgacttggaagccgccgaggacaccaatacacgcgctaagctggcactggatatttttgtgaaccgcgttgtgaaatacgttggctcttacgttgctttaatggatggcgtcgacgtgctggtcttcaccgctggcattggcgaaaacggtgacgagatccgtgataagattatgcggtcgcttgattacctcggcgccaaaatcgacaatgatctgaattacaagtcacatggcgttgaagcagatctaagcacggcagattcaaccgtgaaaacgctgctggtaccgacaaatgaagaacttatgattgtacgcgatgtgatggcactgagctaaacctgaatcacaagcggttgccagtataaaaattgaacattaccaagacgctcctccaaaaaagcgctagagatgagttttatgacttgtctctagcgcttttttgcatacttgttgcagatacgctacccatttaattaatgcgctcaatcgaaaattcggatgtggttagcgcgagctgcattaacaattgcttcgggcatcactttgtcagtagcaatatagtcaagcgtattcatcggggcactcatatacagttggtgtttaccgactttggtgtgatcgactaacaacatcacttgatcagcgttagcagcgaaagctcgtttgatgttggcttcctgatcattagcatcggtggcgcctgtagcaatgagaccgcggcaagaaaaaactgccagatcggcttgataattctcaatatcacgagttgctttgtctccgctgatattctccagcattttattgacagttccgcctaccaagctaacataccaaccattgcgcttggaggcttcaagcgcaaccaagatgccatttgtgacaatgtaaagttcatcaatatccttaagctcgcgaataaggactaaagaggtggtgctggaatcaataaagagactcataccacttttgattaatcggtttgcgcgtgtggctaccacccgtttggcatccagattcaaggtgaccgaataatcatatggaacatctttaggttcttcacttaacgttacgccatttaaaacccgtctgattaaaccacggttctccatatccaaggtgtcacgcctaaccgtagcaggactgacgaaaagttgttttgctagatcgctgtatctagcgaattgctgcgtattaaggatctttaaaatttggttttggcgttgaaatgagaccactaagaaccccttctttctcaaggtgcatcattttatgcaaaattatagcaccgattcgaaaaaaagtgaaaaattttcgatatggtcgtcaactattgtcaaatattttcaatcccctatactacgagatgaaagcggtttacaaacacaaaggaggtacatcaacgtggcacttatgggattggatctcgggacgaccggtgttaagagtacgattaccgataatgaaggaaatatcctttctgctgcttaccgagaatacgagacatcggttcccagagaaggcgaatatgaactagatccgagtgtggtctggtcagcgactaaagaagttattcaagagtcaaagaagttcgtgaaagaagatgtgctggcagtcagcgtttcatcttttggcgaggcatttgtagcagttgatgctcaaggccaaccgttgatgaatacgatgttgcagacagatagccgtggaaaagacgagttgaatgacttgttaacgcggatttcagccgaagaaattcgcaataaaaccgggttgaatcccgcggtcactttcgcggtacctaagattatgtggatcaagaagcatcgaccggagatctatcaaaaaattcatcgtatcctgctttatggggcttatattctgtacaaacttggcaatgttgatgccattgactacacgttagctgatcgttcacttgcatttaatgtttctaccaacgactgggattcagatatattggctgctgccggcattgatcgtcaactattacctaagtgttaccggcttggtactgtcgttggaacgatcaaaccagaattagcttctgagttgggtgttaatctcgacatgaagttggtgaccggcgcgcatgaccaaatctgcgtttcaatcggtgccggaaccattgatgttggggatgccacggatggtatgggatcggttgacaatatctcgccaatctttaccgacactagtcatctcaaagaaaatgccaagaaaaattatccgaccgttccttatctggataacaaatataccacgatagcttatatgtacgatggtggaacatccctcaagtggtatcgcgatacttttggctttgaagaagttcaagcagcacagttatccggcgtgagtgtctatgacatctttgataagtacgttccgcaaaagccgacaaatttgctgatactgccgcacttttccggcgctgcagttccttatttcgatgaggatgcacgcggtatgattctcggactctcaggagctacccgcaagcctgatatttatcgggcattgatggaaggggtggcctttgaaatgcgaatgaatctggacaatatggaagctggtggcatgcatgtcaacaagttgcgggcgaccggtgggggttcacgatctgatacctggctccagattaaagctgatgtcttcaatcgagaagttgatcgcgttcatatgaaagaatccggaacgatgggcgtcatcatcatggccggtgttgcggttggcttattcgattcttttgagtctgccatgaagaagctggtcacgattgataaggttttcaagccaattccggaaaacgtggcgttctataatcgtcaatataagaaatatcgtgagttatatgcatttggtaaaaagttacggagcttataggagggtaaatcatggttttagttaatacaaaagaaatgattaaaaaggctaaggaaggccattatgcagttggttcatttaacgtgacggacattgaaatgattcgcggaatcgttggtgcagcggagaaggaaaactcaccggtgattatccagtttgctgaattacatgataagtatgtgccactggatgtgattgctccggttatgctaaacgttgcgcgcaaggcttcggttcccgttgcagttcattttgatcacggtgaaactttcgataacatcatgcgagccattcgattaggcttcacttcggttatggttgacgcgtcacaggaaaattttgctgataatctggcccaaactaaagaaattgtcaaaatttgcaagcctctgaacatttcggttgaagccgagcttggaccaatgaatcgtgaaggcagtggcgataagaaagttgattatgccgatctaaataagacgtatacgaaccctcaagaagctaagcaattcatcgaagagtccggcattgatatgttggcggttgcatatggaacggttcatggggtttatacccagaagccgcacttaagtttcagtcggttaaaggaaatttctgatttggttgacttcccactcgtcgttcacggcgcttctggattgacagatgaagaatatcgtaagtcagttgaaaatggtatttgcaagatcaattactattcggaaatggttcatcgagttgcgttgggtgttcaaaagaaattagaacaagatgacagtgataaacaactatttatttcggacgctagcatttgggaaaccgaaatggtcgaagaagaaattcgcgggcgactacgggtcttcggttcggcaggtaaggcttaagcaattcggaaaacaggcggataggggactgtccgtctgttttcaaggaagaaatgagagcgcttcagtttagagaatagacggcgctcaacatataaggaggcttttttatgaaatttctggttgatatgctcagccagccttccatcatcgccggaattgttgtcttagtgggcttgatagcattacgtaaaccgtttaccgaagtcattggcggaaccgttcgagcatttatcggttttgtcgtcatgcttgcaggtaccaatattattgtcggtgcgctgaataactttgctaagctatttaccaaggccttcaacatgcatggcatgattcccagtaacgaagcggcaatcggagtgacagttgctaaatacggaacggttgcaacttttatctttgtctttggacttgtattgaacattgtgttggcgcgtattacgaagtttaagtatattttcttatcaagtgaccatgcgttttacatggcatgttgtttaacgccgattatgatcttaggcggcttaaatacggttgaagctatcgtctttggttccatgactttaggtgtcattctctgcgtcttcccagccatcgcccatccaacgatgaaaattattactggacgtgacgacatgagctttgcccatttcggcacattggaatactggctatcggcaaagatcggatcacttgtcaataagaataagaaatcgaaatcgattgaagatattaatttcccgaagtcattagcatttttacaagatagcaatgtttccgttacgattgtgatgaccatcttgttcttcgtggtgacggcagtggctgggccggcgtatgttggtaagctaaccgacttgaatccatacgtttgggcgctcttgcaagctgctgagtttaccgcggggattatcgtcttagtccaaggcgttaatatgttattagctgagatcacacccgctttcaaggggttcagcgaaaagattgttccaagcgccgtacccggttacccatttgccattctgtttaagggcacatccaacgcattactggccggtttcttggtaagcttactcggcggtttactttctatgggggttcagatcataatcgggacaaccattgttattccggggattgtgatgcacttcttctgcggtggtatcgcggcaatctttggcaatgctacgggtggtcgcaaaggtgcgctgattggaccgtttatcggtgggattattctaagctttttgcctttggtcgccaccggtctttatggaggcttgggttacactgcaacttattggtctgatagtgatttcaatacaatcggggtcttacttggacttgttgctaaagttggtaagtggccgatcatgctggctgcattgattatctttgccttcccatttgtctttagtgctttacacaagaaaaaactggttgattaatagcaacttttgaattaatagcgctgatatataaaaagtcgatctcatgaagagtggccgcatggcaaacgcgactgcttttcaggatcgactttttatgtactgcatagcgatctgagttttctaatgcgcagattttcagaagttattcggcgttaatcccttgatcagagtccaccatgacgcccttcgtttcatcaaacacgcaaatgttgccatagttttccttaaatcccatgtgattgcccccatcaatgaaataacgcggcgattcatgggggtactgaatgactttaaccggacatttcggatagtttccagttaagggagtttcgggaactggcggtttcgcatcgccggcatagtcaccgtagattaaggcagttggtgtatgtccggtaacaatggttttgttaagcggattgtgcgcaaagatgggatgctgacgcgtttgggtttgctgcatgtcataaatataaggctcccggacccacatgcggttaaacggtgtggtctcttttaaagggttctctaaggatagatctagtccggcgtgaatcagtaaaagcttgtcaaacgtcaccgctgtgggcatttcagcaatgaatgtaatcagaggcgcgatatgttgctgcaccgcctgccgtaaattggacttttgcgcgttggcagggacaaaatccttgatcatttggcgcaacgttactttaccgccattgatgaaccaaggattatctttgtccgccaaataatccagcaacatctgatcgtgattgccccgaactgcaattgcctgactattttggacctgttcgtgaatctgactcaaaacgcggccgccatacggatagccgtcaatgtagtccccgagatagacggtgagtgcatggggatacttggcttgcatcaagcgaacacgatccattgtttttaaattgccatgaatatcggatacaacaatcatggtcatcgcttttgcctcctcacgtctttgtcgtcacttttttgccagcggtggtttattcaacatgccgattcatacacctataaataacggttacgtctagtttactttatttttgcctgattgtgcgatattaataagaggttaggggtgaaaagatggataaacggttaattgtcatgcacaacttgagtcagcattacggcaaacagtattggtggcagcaaaactcactggaagattggttgatgatgatcctgatccagcgcaccagttctaagaatgtcgcgcaggcggtgcataatttgcggccttacatgcaggttgatcgcttgctggcgctaacacaaccggaactggaagcacttgtgcgaccggccggattttaccgccaaaaagctcagcgcattcatgatctattggtgtggtttgtggctcaaggcggcagttttgacaagattgcccaaaagccgacagccgaactgcgcaagactttactggcattaaacggtatcggcaatgaaacggccgatgtcatgttgatgtacacctttggcaagaaaacgtttgtcgcggatacttatgcgatgcgcttattcaatcgcttaggtttcggcccctataaaaattacgctaaaatgcaggccgattttaccccgctgttaacgggcatcagtttagatgatgcgcgggaatggcacgctctcatcgatgaacatggaaaaacgcaggtacgacatgcctatgatgatcattttttgcttcagcccaatttgcccgaagcagcctggccaccggaagcaaaacaaattgagcccccgcatgacgaccctggcagcggcaaatggcgcagaatgtcagagcagtctgacaagtaggcaagccgccaattttactgaataatgtcacggttaggatcgcgccagttaatgacaatgacgaggagcatgatgatgacgaccatgatgaaaacaccgtggaggccagtgagaatggcggcggcagcatgaggatcgtggacggtggttgctgagttggcgctgatcgctgcattgacggctttaaaggaagtgccatgcagattagcccggatcacaagcgttaacacagccccataaacccccgtcataatcgtttgtcccaacgatcgccctagagtcaagatgctagttgccgagccgacatagcggtcaggaaccaagtgttggctaagcaccgtgttcatactaatgacaatccccatcaccgttccgttaatcatcgcaatgacataaaaagcccaaaccgggaatgaggacgaagcaaatgtgagcagtaggtaggctaacgtcagaattgtgaccagacccagtgtcaaagtacgtggcaccatccgcttaatcaaagggtcaactaaaaacgacgaggttaaccacaatacggagctagaagtcacaaccaagcctgcagcggtggcgcctaaatgataaagcgattgtaaccagatcggaaaataaacctgataaccgattaagacgccactaagcagcaaagccgttaagatttggacggtaaaggtgaaccgatgaaacatctgcggcgcgattaaagggtcaacagcgcggtgttcttggcgaattaacagatacccgccgacaatggcaagaacgattaaaagtgcggctaaccacggctgctgatcaagtgcttgaatgcctaaaagcaaggcaaccaaagtgacagctaaccaagcgattccgagccaatcaatcgtaagcgacacatgttcccgccgcggttcccgatagccaacttgaattaagccaaagaccagaattcccagcggcacattcacaaagaacacccagtgccatgacaactgatccaccagaaagccaccgatcaaagggccaaccaaggcggaaagtccccaagccgtattgttaagtgccagcacattcgcgcggtgggcaaaatcgtaatagtccgcaatgatggtaaaagttaatggcatcaccgcaccagcgccaataccttgcaacgcgcgcgctaaaatgagcagtaaaatatgcggcgctaggccactgagcagcgtgccaagcgtaaacagcaccacaccccactgaaaaacgccacggcgcccaagcgtatcagccaacttgccataaattggggttgtaatggcagttgtgagtaagtaagcactcatgatccagctttgataagccagcccatgcaaatcactaataatcgcgggtaatgccgtcgtaacaatggtgacttcgaccgaggtcatgaaagtcgcaataaaaaccgccgccataacgaggccgcggccttgaggttttgtcgatgtagacatgtggccaaccatctccttaatagctctattgtaacaattaaggtcaagagctttgaatggttatagtttttcattctcaatgtaagagctacaagaaaatgtatccctgcaaccactagcaaagctatttagtggctacagggatacattgaatattgaatattaaatcgccggccgtcttggatgatgcggcgtttgagtttgatcaatgacgactgcacctagcatcaaaataataatgatgacagctgccattaattgcccaaagaccatcaaactaaaggcgccgatgaaggcaaaaatcaacaacaaccaatcaagctctgagaatgacaacccaatcatctccttaaaagtcagactccgaggcatcgtaactcattgccttgctcggcgacacatagacgacaagctcatcgctgaatcgcttgagacaataggcaatgatgccaatagcagcaagcgttgtgacagtcttaatcagcggctttttcatgctctcgctcctttgcttgcacattatatagaaggtattaaacacatcttaagtttacacccgctgcatgaagatagcagaagcgaggtggaaaaattgagctcatggttcgggatgcgccatgatcgggctagcaggcactgacggtaacaacatttaaggcaatttaagcgaatttaagtcaaaataagcgctttttgccaaaactgtggtatactgaaggcattaaaaccgaaagtaggtatgagcatggatacaaaagtaaagaccgttgattactcatccaaggaatactttgacaagatgaccgcttattggcgggcagctaactatgtgtcagttgggcagctttatttgaaggacaatcctttgttggaacgaccactgaaaagtgaagatgtgaagccacatccgatcggccactggggaacgattgctgggcaaaacttcatttatacgcacttgaatcgggttattaataagtacgatctcaatatgttctatattgaaggtccgggtcatggtggccaggtcatggtttccaactcctacctcgatggttcgtattcagagatttatccacgggtttctcaggataaagaagggatgaagaacctgttcacccaattttcctggccgggtggtgtggcatcgcatgcgagcgcccagacgccgggctcaattcatgaaggtggggagctaggttatgcgctgagccatgcaaccggggcgattttggataatcctgatgtgattgccgcggttgtcaccggtgatggcgaaacggaaacgggtccgttagccgcatcttggtttagtaataccttcattaatccaatcagcgacggagcaattttaccgatcgtgcatatgaacggcttcaagatttctaacccaacgattctgtctcggaaatcagatgaagatctgaccaagtactttgaaggcatgggttggaagccatactttgttgaaggcgatgacccaaccaagctcaatcctgagatggcaaaagttatggacgctgcgatcgaagaaatcaaagcgattcaaaagcatgcccgtgaaaccggcgatacgacaatgccgcattggccagtgattattttccgctcaccaaagggctggacgggtcctaagagctggaatggcgaaccaatcgaaggctcgttccgtgcgcatcagattccgattccggttgatgctgaagatatggaacatgccgattcgttggctggctggctgaagtcgtaccatccagaagaattattcgatgaaaatggcaagttgattccggaactggccgcgttaccgccaaagggtgacaaacggatggccgctaacccgatcaccaatggcgggcttgatcctaagccattagtattacctgattatcgcaagtatgcactggataataccgagcatggcaagcaaattaagcaggatatgattgtgtggtcagactatctgcgtgatttgatcaagctgaacccgcataatttccggatctttggccctgacgaaaccatgagcaaccggctttacagtctgtttgaagtcaccaaccgccagtggctggaaccaattaaggagccagctgatcaatacatggcaccggctggccggattattgattcgcagctgtcagaacaccaggcggaaggctttaatgaaggctatacgctgactggccggcatggtttgttcacaagctatgaagcattcctgcgcgtggttgattcgatgctcacccagcacttcaagtggattcgtaaggcccatgaggaaccatggcacaaggcttatccaagcttgaacgtggtttcgacttcgacgtccttccaacaggatcacaacggttacacccatcaggatccaggcattttgacccacatggcggagaagaaagccgaatacatccgcgaatatctgccagctgatgcgaatagtttattggccatttcaccaaaactattcagctcacaaaacacggttaatgtgctgattacttccaagcagccgcggccacagttctacagtattgatgaagcaactgttttggccaatgctggcttgaaacggattgattgggcttccaatgatgatggtgttgagccggatgttgtcattgctgctgccgggaccgagccaaacatggaaagccttgctgcaatcaacttgttgcatgacgccttcccagacttaaagattcgcttcattaacgtgcttgatcttttgaagctgcgcagtccagaaatcgatccgcgtgggttgagtgatgctgaattcaacagttacttcacgacggataagccggttctgtttgcctatcatggctttgaaggcttgatccgtgacatcttctttacccgtcagaatcgtaacgtcctgattcacggttatcgtgaagaaggcgatatcacaacgccatttgatatgcgggttctaaacgaacttgatcggttccacttggccaaggatatcattcagcatgtaccggcatatgctgaaaaagcggctgcctttgttcagaagatggatgatacgttgcaatatcaccacgacttcattcgggcaaacggcgaagatattcctgaagttcaggagtggacttggaagtcaattaagtaataccaatcgagtcttggtacaatcgctcagataattaacaaatcggtattagcaggtgaccgctaatgccgatttttattttgtgaaattaagtttagatgataactattttaatcgatataaatacgagtggcgatgtaaccgcatacgctcatggcgatgaaccggtttaagaaaaaatgtcaccgactgtcagccaaaaagtgaacaaaatatgaatactatggcaaaaattatgtaaaaaacacctttacatctcacgagttctaatatactcttaatgtattatcattttgagggtgagtagatgaaagctaaacgaatgatcgccggggcaatggtagttgcctcagcagttctcttggttgcatgtggcagcaagagcagcagtagcaccgaaacgtttaatcgaatggaaaaagatgtcatttcgaccatggataacgcgcatattacagatgttattagtggtcaggcagcggtcgatacgggcgatggtctctatcgttacaagggtaagaaattgcagccggctgtcgcaaccaaagtggtgaagccgactaataaggggcttacgtacacgtttaatctacgtaagaccaaatggagcaacggtgatcctgtcacggctaaagattttgtttttgcttggcgccgggcaaccgatcctaagactaagtcagagtatgcttatctgttctcgggtatcaagaacgctgacgatattactgccggtaagaaggcgccatcaacgttgggggtaaaagcggaaggcaactacaagctggtcgtaacgatggaacgtcccattccttatttcagtactatgatggttaacccagtcttcttcccgttgaatcaaaagacggttgaaaaatatggtaagaaattcggaacgcaaagcaagtatctggttttcaatggaccgtttaagctgactaactggaacggcacagggaattcatgggacgaagtgaagaataagtcgtattggaatgccaagcaagttaaactagacaagattcatgttcaggtggttaaagacgctaacactgcggctaacttgtttgcaactaagaaacttgacgatgctgttttaaccggtgaaatcgctaaacagcatgctaaagataaagattacgtgggcgacaaacagggtcggacctcttatcttgatatgaacgaagaaaaggttccggacttcaagaacctgaagttacggcaagcggtggcaatggctattaaccgtaaagagttcgctaataaggtgatcggtgacggctcatttgggatttcgacacttacgcctgaaaactctggctcaaatcctaagacgggtgaggacttcgccaaggaagcagctaaagaatctgaaacggttcagtcatacaacttgaaggaagccaagaaactttgggctgaagggctgaaagaagttggcaaatctggcgaacaagttacactgacgacagacgacacggatgttgctaagaagtcggctgaatatattcaatcagctttggaacagttacctggtatgaaggtttccatttcctccgttccattcaagactcggattcagcgttctttggatggcaccgcccagttcattctctccggctggcaaggcgatttcccggatccgatttccttcctggatctttatacaactggaaacacgtataacttcagccactggtctaacaagcaatatgatgagctgatcaaggcttctgagaccactgatgctaacaacgaaacaaaacgttacaatgatcttttgaaggcacaggaattactttctaaagaagccccagttgcgacactgtatcaaaccgttcaagggcatttacgcaatccgaagttgaagggcgttaccttcagcccagccaacatgtataactttgttggtgcgtatatggctaagtagtaaagattaaaattttcatttgaaagcccctgcttgcgttggcgtacttcaccaacgtaggcaggggctttttgtgtgagcttcagctagcagatattaaagagtttgtattgtggtatatattatataataatttcaaaaccgataattctacccaaggccggattaataatgatgtaagataagcacaacacacatatgttaatgaataatattttgataaaaataatctttaaataaaagtaaaaataacttaaaaatatattatagcttaataaatccgtatagaaataaatatttatttaaaaatggattgactagattggattttacaccgtataatttctatgtaatgttctagaaaagacagcacagggcagttaatgcttcacatgggcatcgctacgagttttatacgaacacaaggctggatatgtacaattgtgtgattgaagactgttgttctgggatttcaacaactgtttacatgcagagctggcgtaacggcaatgctaacggatggcggaaaccggatatttaatattttggaggttctatgatgtgccgctctttataagaatggagcggcctttttgggggttgatctctttgagaaataaacaatactggcagtcccgatcaaccatcacggctttgttactcgcagttttatttatttcgggccacctgattgcaaatgccggctatgatgcagatgggggaaagcatttgacgggtttctactttttttcgccatatatgaactggttgccaattgatatttcttcaagtttacctgttgcatggaatttggctgcgccgcttttatcagttcttgccggtggtatgatcgctgcttcccatgggcgcagtgggtatgccaagttaatgcgatttcggcacagctttgtggcttatcgcaggtcggttttcttggctgcgggcgttcttggtgcaattgtgccaatcatggtactgggtttagacttcctaggtttgcttgcgattcatcctaatgtgctgccgaatcaatggctcaataataatgttgcgattagttatttgggacttggggggaatcttttttatacccatacttgggcctacatgttgggatggattgctttgctagccttttacggggcaagctatgctattttttcgaattttctctattttgtcacagggaagatggtgctgtcgctgatgggggtcatgatggttcagttaatattattaagcatttctataatctttaagacgagtttagcgcctattacttatttacagattgttccaactattgggcaaccttcgctagtctacgttcttttatggcccgccattttaattgcaatgagtctttttagctttcgagtgccaaaaatcgaggcttagtttatgaaaataaggaaatatcagttgtttctacattttatttcacgctggcaaagcattttgtttttgatgacagtgcttgttttcgccctgactttcgttcttgccggaattatgacgggacggtttgagatcagccaattggatgccaacatttcggttcaacgtgcatttggacaggtgatattttatttgcccatcgttgggatgatgacgtttttacttgtgagtcaagctcaaaacacgagtcttctcataagaattggttccagaagtttgatagcaaaatatattttgcgagtgttattttatttggatcttgtgatatcggtggcggtctggatggtctggataactgcggtgcttttcttatcgcgaggtcaaggcggaatgacgtcggttgcggctaatgccaatttattgatgaatatctttaccgggctgtttttgtatacgctaatgatacttgctctttgtgtcgtttttaggtctagagcgattggtatttccttagggctgagtctgattatctgcttttatatcgttccttttgtcaatttaactgaagtcgcaaatctggtaaccccgaagttaactaaagatgcaatatggccgatcaatattgctaggcagtggttggcaatattcattggcgctcagataatcacgatattatttaaccatgttcgcttgcctgtcgaggggtgaaacttaatgaagatacaatggcaaaaaccgcttattgataagcgcatgatagtggttttactgcttgaggtcttactcttgataagctcgctagcgttgtattttgatcaacagaatagcaagttattacgacaagttcacgatccggtgatgactgtatttattggcgcaatgccggatcggtttgcgagcagtcagttgtggtggttgcttctgtgggttggattcatgtctttacccatcttcatttgtgccggggtgacagatgcttatcagcgtaatttgtatacgtttcttagcttgcggatgcatcgaagacttggtgcttatatctggcctttaaagcaagtggttttgagggaggcaagccttttattggtagtgggcattgcagtcggcacactgacacatttctttttgaggacgcagcaatttggcgaggctggcttgttcattattcttattattgtgagtcaaacgtttttagtggttttagaagcggttcttgaaggttactttggccccatgattggggttgtcggaacgttaacgatcatctttttaagttttctgcaaatgccgttgatgcctttgcgtttttccattggaagtacctttgcaacggattcacagttattaggtgcgattgggtatcagatcattttgatcattcttttgctactgattcaacttttttatatgccaggaaggtggggccgatatggcacaggtcgggaataaatcaggtgttcgtgttgatatttcacaaatgtccgtgatgatgagacggaaaaagattcttgatgatctttcactttcttttgtctctcctaatatttacggcattgttgggccaaacgggtcaggcaagacagtttttttaaaagcaatgttgggatttatacggcttgtcagcggtagtgtgacgatgaatgaggttccaattgatccgcggcgggcttttccgataagtgtcggcgctattattgagcatccgggttttatgaatgacatgagcgggcatgataacttattggctttgggacagattcgtagtcagcttgatgatgaagcgattcatgccgtgatgactcgagtcggactgccagatgacaaaaagccagtcgcaacctattcgctagggatgattcaacgtttgggaattgcccaagcgatcatggaagatcaggaatttattgtgttggatgaacctactaatgcactagatcgtgaaggtatcgtgtttttgactgaattattaaaggaacttcgcgaccaggggaaattagtgctgatcgcaactcacgaccttttgtggttgcaatcgctagcagatcagatatttgagttgtccaatggtaaacttcagcaggttgaggatgtggtttaatgatgaagtcggtgcatcggcgaatttactttttaatcggcggttgtgcaacagtgatgatacttcttgtagggctgtttgtttggcgctatcaaacccttaatgcgaatgttgcacagccggcagtttgtaggcgacggctgcggttgccggcaaaagtggttctgaatcagacaacggtcgtgctcgaaaagctggaaacaaaggtaacgaatgggcgttggcgggtgcgactgattttgaaacgcgcaattacgaaacaaaaccttcaacatatccgcattcaaatcgcccaacaccgcgaaggaagcgaagtagcgaatgaacaacttccggtaatgagccgggataagaaggtattgactttgacggatacctattatagtcaggcaaaatataatcgtgttgtcatgacgacattgccaagggttgcacgttcacaaaatctcgttcagattgtaacgttcaaggaatgagatcgtgttaacatagcttggtgactgaatgcggtttagaggagttgagcgctgtggttcaagaaatagacgacttgagatttcaactttcaccacatgctaaatttgatttccgtgctgccgttttactggtgcatgacaatcaagtgttagtaacggtgcagcctactagtggtgttgccattgtccccgggggtgcagtgaagtttggtgaaacttccggtgtagcagctaagcgtgagctatatgaagaattgcggcttcaggtcgatgagccgccactagtaggcgtacttgaatcattttggcaacagcctgatcgaacctatcaacaactgatcatggtgcatcgcttggtactgtcccaggcgcaaattgacgaactggtttggcaggaggggctgcaggggcagtggttgccgaagtcagaggtggctaaacacttgcaaccgcgcgctttgacacaatttttagaacctagtgcaacacttttgcaccttgtcgatcatcattcggaatgaaacttgagtgacttttcggcttgaaagcgcgcacacgagggcttaaattataaaatatataattagaggtgcttattttgcctttctttgtcaaccttgatacgcttaaggtaggctacagccggaagggagttgcatttttatggatataacgactagaccgacgttgcagcaatttttagcggataccaaacagggtccgtatgtatcactgtacatgtcttggccggagcatacaccggttgagaagttgcggatccggttcaagaatatgcttaaacatgtcaagacggtgatggcggaaacctattcggacaccgactttgcgccatatgctgccgaacttgaaccatatgagcaagatccgatgttttggcaagacagcgaagcaaacgggattggtatgttgacgaacggtgcgcaaacgtatgtaaccccaatgtatgaagcagttgatgaagtggcaatggtaactgaagtgccgcagattttgcctttgatgctggatgaggcaacggcaacagattttgatattctggcgcttaacgctgatagtattcagctataccataaccatggtcaccaagtgcgctcggtttccttaccagacgatgcgccacaaacattgaaaggcacacttggaacagaaattcgaggcggcgagttaaatagtgtgtctcaaggcggtggccacgtcacttaccatgggcacaacgaaaaatccgccgagaaggcaagcgatcaacggcgattctaccaggcagttgatcaatatttactgacaaattattcgaatcctaaaaaaatgccgctggttctcatgggcttagcagagaatgtagcggtattccgcgagatttccaagaaccatcatttactgccgaaacttgcagtggtcaaaagtccggcaacgcttgattttgttgagctggatgacttacttgaaccagtgcgcgccacattgcgtgatcggcgccgacaacacttcgctaatgtcattgaaaacgcacgcggcaatggcagttacaccgatgaattggcaacgattgtgtcggcggcattgcgtggacaaatcgccatcctctttgttcaagccggcgcacgcattcacgcgcggcttgaaggtgatcagattgagcgcgattccaaggccgctcagcatgcgaatctgttaaatacattggcggacattgtattaggccacggcggtcaggttgaacttttgcccgaagcccatttatcagctaaagtcggcgctacgatgcgttatgcttagtcaatgattgtgaacaaaaacgagctgccaagttggcggctcgttttttgttggaaaataggagaactgaatttttctcaactcaggttttttatgctaattcgagagttccggtcaactgagatttagtcttttcggtgagatgatgcgtaatcatgatgacagtaagctccttgttggctaataaagcatcttcaattgtctgggcattttcggtgtcgatcccagcggtcacctcgtcaacaattaggattggtttgtgaaatgctagtgcccgtgccaacgctagcttttgtcgttggccgcctgacaggttgctgccatgttcgtgaatgtttgtggttagattagcaaacttatcaattcctaggaaccttacaatgtttgttaatgcattcgtttgtttagcaacccctaatgtgatattttcctgaacgctttcgttaaagatataggacttctggtctaccagttcgatcttggcgtttaaagcggttgtcgccagcgatttcaattcggtgttatcgacatggattgcaccttgataatcacttagccttccactcataagattgataagtgttgatttcccaacaccactttttcccaagatggcatattttcctccgcgtttaaaagtgtaggaaacatctttaatgatgggcttttcgtcatagctaaacgagaggtgatccagggtaagcgcatggtcaaatgaccgatcttcggctaaacgtggtaactgacttaaatggctgttcttgtgaagtaagacgctgacggatttcatttgaaagattccttgcaccatgccagccaaattattgaatactgttcctgccaacgagccacttgccgaaatcaccccgacggagaaatagccaccgatgactaatagacaagttaaagccagaacgatcatttgggcagtgacattcacgccgctgatgagtaggttaacaagcccaacgtttctggcgtagcgaaccttttcttttccttggtaatcagaagcgtccgctagtttttgtgtgaatctgtcacctaagttatgactaaaaaatactgaaaaaccgccgatgatatcatctgacttctctaaaaaagaactattggcagaagcgatccggttcgtttcgtgtgtcataacttttgagaaaaattgtgggatggtcatggtgaggaggcccaggataatggcagcaaaggctagactgtaatggtagaaggccaaagaagtaatggcaaataaaagtgttgcagcattgcctagcaatgagaagaatgtttgtaaaccattttgttcgatcatgttgatatcattggtcaaccacgagacatattcattgtggttgaccttattatattcataaaccggaatactggtgagcccgttcgcgatatcggttcgaagttgattggtgactttgcgaatgatctgagctttcagcaacgaattgacataagcaatcgtcagcgtcacgccccaaattgaaatagttgccaataaccagaaaaccacaccccgaaaattcttgttaataagttgatcagtcagtggtgccaaggttaaagaacttgtaacctttccaagcgattcaatcaaaatcaaaagtgttgtcagtagcgtcagtagtttttgatgtgctaatagtttaattgttggtttcataagacatcagcctttctgataaagttgtgtattgcatcttagggcgatcgtggtatttgatagtgtaagtatatgtgctaatatgattttaattaaaaacgtttcatatatgaaaaagaggcagactgtgaaaaatattggggaagttattaataacttacgcgaacgtaaaggaatgagtcaggcagatcttagtactggaattctttcaaaagcacaactctctaagttcgaacgaaacctaacacaaatatcggctactaaattattagcattactggaacgtctccatgtcacgtttgctgagtttgggaatgcactggcgtttcaggaggctttgtatgagcagtcgatattagcggatattacaaaagcagttgttaacaacaatcgtgatcaagctgaattggtgcgggaacgcgcggcagaacattttacggcgtttccgggaaaatataatcaacttattttaatcatggttaatgctatgatcgctgatatgaccggtgaaacgctttcccaagcggatattgacgttttgacggactacctctttcatgtagatggttggacccggtttgaactgctactttttggtaatacgatatcagctttacctttgcgaactgtcaatcaactggcgcgtgaattggcggctcaagttaatgtggcttgggagattcaccaaaattttcagctgattatcaatttgttatacaacgttgtaatcgtaaacttgtctgctagagatctaacgacagcaagacactatttgcgagtgatgaaagatagtcatgttgaagatggcatgatggcagaacggtttctgattgcacttgctgaggcgctttgtatctactgtgaggacggtacggcggcgcacaaagatcaagtcgaaaaaattatcgccattcaaaaagaacttggtgcgacaaatttctttattgcatttaaaaatcaagctgaaatgttcataaatgaaactaagcaaaccgatgcttttccagctggatggcaaagttatatcttctaattcagatcggctagataaattgtcattgagctgacatgattaatcttcagcaaactggattaaatcagtcagatgtcaatgcacgaaaaagctcaggtcgtcctctggtgtgatgaggtaacctgaactttttggttgatattcaaatatcgcgataccagtgaatcacccaaaaatcactttgacaatttgttcagcggttttgaggctcacatcattgaccagtggccgcgggctggcagtggtgagccagtgaacgccttcagtcgggacgccccagaagaagaggccggcttgtggatgttctttttggtcaagtagctgttgggtttgacggtcaatggcaatagcgcctgactggaagcgtttgtcggcgttgagctgcagttcataagtgtgtgcgtacccgtcatgaagcagctgctgtactaatggattttgggcagtgggcgcattgactgccggaacgcgtgcttctagcaaggttttggcttgaagcgaaaattttggatcgctcggggtttttaaaagaaattggccgtcaatacctttgatctgcatgccgggcggtaaaatagtgacgataccggcacctattagtgcttgcagttggtcaatccgcaaagcaggcggtccgattgaaagaaaatcattcagtgagttaaaccagcgcaagaagaagtccaggtattgatcctgactgagaagattacgctcaacgagttggcgaatgggatcacgcatgtcgcgtaaaacttcaagcgcgctggtcagtggtccggttttggtgccgcgcatcgcttcttgggcatcctggcgcagataatgccgcatgaagtcttggtacggttggccgcttggatgcgccttggtgggatcagccaaagcatcccaatcgagacgatctttagcggcgattggcagtgctcccaaggtggcaacagggtcggcgataaaatcgcgttcaaaagctgcctcgtcaatttctgggtagcgttggggcaacaaaagccgatagtaaatcaactcggcttcgtgctttaaggcttcccagaaggtttgaccgctcacttcgccatgagtttgccaagcgtcaatttgttgtggtgtcaagaaatgcggctgccattcttcacccggtcccttttggttacggcctttagcacgataaggaaaaccgcggcgggagccggcaaaaatatgtggttcgcggccgctgggatgataaacaagcagaccgtctggcgctttttggaattgtccgccgcgaccttcagtgagacgactcatcaaatcaaagaaactcaagcccagtccgcgaataatgaccggcgattgtgcttcgatgccgctgagatcaccttcttcggggaaacccggttccaggtaaaagagctggtgtgtttgcgcataatcgtgcaatgccttttggtcgcgcgtcaatgagttttttagatttcccaaggccatgaccacttgatcggtttgccagctctcttggtcggtggtgacggtaaatccggcagcttttttatctagccggttcacggtttgctgcttataggtgatgatgttggtgccggcttggtatttttgcaagtcaaagaaccactgttggtagacgccgtacaacgcgcgggacgcatagctgttgggtcccagattggcagcctggcgcatcagaatcgaacggttgttaatttcggggtgagcatcgaggtaatcggcagcaagcgtgagcgcccaggtgcttaagtccggaccggcaataaacggtcccacgcctgtcactgtttgatcggtaaataaggtgatttgtgccgcagcagtattcataatgagattagggtcttgatcgatcttccaaacgcgaccgccaattggatacggatcaactaggaaaatggtgagttggcgctggggataacgggtccgttgccaactgataagccgacctaaaagcattaagccacgtggcccggcaccgataagcgtaatgtgcatgccgcatctgctcctttatgagatgataaattaagaagtaacaaatttattatacttggaagtgtccctaagcagttagcgacttgctttaggtttcaccgttttcgtgtcataatgtccttattaaccatctagaagggaaggcagatgctgatgaaagttgtcgttgtgggctgtacgcatgcaggaactgcggcagtgcgcgaactgttgatgaggcacccggaaacggaagtagatgtttttgaacgtcgtgaagacatctcttttctttcatgtggtattgccttgtaccttgaaggcacggtcgggcggttggaggacatgttttacgcaacgccggcctcactcgaagcattaggtcccaacgtgcatgttcacttaaaacatgacgtcttatccattgatggtgccggtcatgtgattgtggctgaagatttgaagacaggcacacaacagcattatccgtacgacaagctgattatgacaactggcagctatccggttattccaccggtttccggtgtgagtgttccgcgggtcttgatgtgtaaaagttatgatgatgcacgtagaatcaaggagagtgccaaagatgccgaaacgattgcaattgtcggtggcggctacattggcgttgaactggcagaggcttatagtcgtaatcaaaaacacgtgattttaattaatggagttgcgccgttgctgagccattatgtggatttaccgcttagtcgagaaatttcttcagtattaacggagcatggcgttgaattaaaagtcaacacggtggcacgccatttcgatagtgacgcggagcatgttttcattcagacggatcacggtgagattcaagctgatttggcagttgtctgcgttggttttcgtccgatgaccgagttgttggttggtcaggttaaaatgaatcatgatggctcaattcatgtgaatgattatatgcaaactagcgatcccgatatttttgcggcgggggatgcggttgcggtgcattttaatccgactggtaaagatgcgtatgcgccactggcaacgaatgcggtgcgtcaaggaaaaatggcaggtgcaaatatttttggcccaacgatcaagtatatgggcacacaggcaaccagtgcgttaagattgtatgatcatagtctggcggtcacggggctgacgcttgctcacgccaagcgcaatcaactgccggcagccagtgtgacgatggttgatgattttcgaccgccatttatgccgcacacggtgaagattaccatggtgctggtttatgataccagtaatcgtcaaatactaggcgcacagttttacagcaagtatgatgttgccaatgcggccaatttgatttcggtgatgattcaaaatcgtaataccattgatcagctggcctatgtcgatatgctctttaatccgaattatgataaaccgtggcattatctcaatttgttaggacaattggctgtagcacaagcagacaactcagcggtgtagggggaaaattatgaattcgtggaatcttatcggactgttcgcgtgggtgatcctgatcgcctacctattcttcatcatttggcatattcggcggcgacatattaaagctatcgtcaaatccgggcggcaggtttccccttccgtcgtgttggttgatctggtagaagtcgcggtgttgttgctagcggtcgccggaatggtatgggtgagttggttgcgtccgattgactaccgggatagccatgaggtgacgattagccacagtgcacaaccacttattttgcagaccggtgatgaacattccttttatgtacgggttcgcacgggaaatggtaagaatccgattttgtactatacttattggacagaaggcgccaagtatgaaaacacgagtcataacgcggaagtgagctccggcagccaaccactgacaccgcgagcggccgcatatccgtggtccaaaaaggaacttaaaaaactggatcaaagcgctgatcgtgcctatgtcgcaactgtatcggcgcagtataagcctggttttcttaacggcttaggcatgcatgtcggtcacagtgccgatcggttttcgattttacgggtgcctaatgatacatttgttgaaattgatccggttgaagattaaagcgcgttaactaaacaatttgaaagatcgctggtgggaaatgcggcatcagcgatcttttttcgattgacaagcttagaaaaaacgaagcagccgcgattctgcgtgtgctttttgacttagccgaatcgattagtccgcggtacatggtatgatgaaagcatttgaaatgagtaatataaaggtgcttgctgaccgcgctggctcgcgctcaccataacgcgctccccggcgcagaagtctgcgtgtaagaacctcagtcgcaatggccaagagcgggccatcacgcctgaggccgcttacactccgacttctaaccgcgccggctcgcgctcaccataacgcgctccccggcgcagggatctgcatgtaaggaccttggtcgcaatggccaagagcgggccatcacgcccaaggccacttacactccgatccctaaccgcgccggctcgcgctcagtttattaggaggtttgcagatgaatcatcgcagctggtggctgctgccgttgttgctgcttttgggctttggtcttgcggggctgcaaccggttcaagccgcttcaggtaaatggtatcgagataatggcaacatgatggggtctgaaagtaagacggttatcaaacagctgaacgaccaaacctttgccaaaataaccggtcatccccaaattgccgtgatcaccgtcacgtccttgcatgatgaagagattgaagactatgccaatgagcagtttgctaagcttggaattggcaaaaaaggttgggataacggccttttactggtgctttcacgccgagatcgtaaatattggctggaagtgggttatggactggaagatgtggtgccagatggcagtgccgatgagattgtcactggctcggtcaaaaaactgcttaaagcggaagactacgatcatgccattgcgttgtttttgacaaatatcggtaagcgggttgcggctcatcaaagcgccattgccacgccgacacagataaaagccaagcgcgcccatgatgccgccgtcaagcagcttttgataacggtggccttggtagtggtcggcatgatggtgctcttcttcatcattcatgctgccataaccgctcgcttacgtgatgcgatgccccatgtagctgctatgcagacgttaccgatctatgccgctgtgactgctgccgggattaaactgcaattagacacggcggcggttccgctatttcgcttcgcttggtcgcatgacaaattgcgcgtgatcgggatggcgaatttgacaaggcggggatttgaatcgtggacgcgaaaagtccgaatgatggtgccgcacccttattggtactatgacaacgttcgcggagcccttcgcaagttgccagatcagacactggtgaatgcgccgaccattgccgcggtggctgaattgttaaacccggcgctggcagatcggtttaaaaccggacaaccttacgaagcagctttcacggcctggttgaatgaacagaaaagtgttgccgggcaagcagcggtgacgacctggtctaagttcctggcaaaagttaaaccgactgataccttctcagatgcaacgctagccgccactttttccgctattcttttccatattcgccatcccgatcaagatcaggatttgagtcaatccgatgtgccattgtgggttatcagtgattttggctcggcgactagcagtcatagtggcgactccgatgactttggaagtggcttcggtggcggttctagtggcggcggtggttttggcggtagctggtaagctagacccgacccttgaaagtgacgcaacacgtaggctaacataaaaaatatatttaaaacgatgggtggcaggtagctaccgccattaaattcaaaaatgaggctagataaatggagcagatgctgttgttaatgggtaccggggtgctaggcggtattctgggagccgtgctgggaatcggcggcgggatgattattaccccgattttgacaatgttaatgggattgccgattcaatatgcgattggtgccagcattgtctcggtcattgcgaccagttcgggtgccactattgcttatctaaaagatgaaatgctgaatttacgggtggccatgtttttggaaattgcgacaacggttggggccgtcattggtgcggttatcactggcctggtgaatggcaaggtattgtatatcttatttggcgcattgttgatattttctgccttcaacatgattcgcaagctgcggatgaaagatgatggtgtgcgccaaacaacccctgatgcgatggccacaaaattacgcctgaatgggacgtattttgacaaggcaactggaaaagaagttaattatacggtaacgaatgttccaggcggttttgcgatgatgtttggtgccgggattgcatcagggctactgggtatcgggagtggcgcttttaaagtgattgccatggatacgattatgcatatgccgttgaagccatcgagtgcaaccagtaacctcatgatgggagttacggcggccgccagtgcaacagtttattattttggcggtcagcttcagccacaaattgccgcaccgcttgcgatcggaattctcgtcggtgcaacggtgggctcgcgggtgatgcaggttctgccaaataaagtcttgcggctgattttcattccggtgattgggtatatgggcatccagatggcacttaaaggatttggggtgaatatctgatggataagaaactcaaaaccgaaatcgatgatgttgaaatcatgattggtaaagtgatgcagattggggtcattttggcggcagtcgtgattatttttggcttgatactcttgttggtcagcggatcaaccggttatccggccggtgttcatccaacgcgaattggtgcgattataagcggcacggcggcactgaaaccttacgctatcctgatgacggggatctttttgctgattctgacgccggttttgcgcgtcgtggtatcaatctatgcgtttgcggttgaacacgatcacttgtacgtgtggattaccaccgccgttttgattatcctgctcggcgccatgacgattgggtatctgggcaaccgttaattaaaaaatagcgcttttgcaccgggttattgatccggtgcaaaagcgctattttgatacttcgtctggatgatgagtggcgtttagcacgcaattggtcatccttcgcggggcgccattacttaccacttggcttgtgttccatgtagtccttcagcgtggcaacgacggaagaatccggcatctcacgcatggatttaatattgtgaatatgttcaactgatacatggctgttaagcgccatctctgtgtccgttagatgatttttacgctggaagtcgataatttcccgtgaaaatgcactgatttgatctttttcagccaaaacgattcctcctcgtgaacctttactaacagtataacgatttttgtcattatgcgcacgtatgacatccaatcgtaactttaacaccattgatttgaaggttttcaagcatatcgtaacgatgactgaagaaaagtctaaaatctgcagatgccgtgttcgtcgactaaatacatgggtgaaacttaatgattgcaaagccgaacaagtgtttgtataataaagatgcactaaggaaatgggatcgcttcgttaattaagaaccgcatctgttagctgcaacgttggttagttgattaggagtgccaccatttaagcggatggtgtgtaagttcatatgcgtgatgatcgcgatcgtaaaatacacgccttgacccgatggcgacaatgtatgcttgcccggttacaagttgttgataaagctttcttttcttgacgagctggatacccttcaacaggactttgaggatgataaaccaaaagctgattaacaaaagccataaccacccattggatgttgagtgaaaagttgaggcttgcaaggttagcataagcggattccaaagcaaagcggtggcatcggtgattagctgatcaaataaagcagttggtgttgcaaacagagatatgagtgtgatgccaaagataaacaatccccaaagcatataaggtgccatgatcaacacggtaagcgcgcggagtaaggaatttggagtatgcaaaacgatagcctttcgaaaacgatgccatgcatagaacggatcttgatcggctatggttatcatctcccagttgttagtgaaacgatttcgtttaacaatctctttttcatacagatattgttttgatgttttccggacaaggtaatcgctagtcttagaatagcgcaatattgccttgatcgaaaggtaaggtgagcttatggaacactatgcctatttgcaggatctggcagccagtcaacgggatcgggaactgcgcgtgcggatttgggataataagaatatcattattcggcgaaacctcagccagcatcagggcttggctactcaggtctgggatgcatggttgcgtcaggagctgcgacgttttaacggttttgagccaattattgaagttgatgatttttccgggcatcaggaaattaagtttttcaaggaaaatgaattagcggatgccgttcatttcattcttcaaggcgaaggggcggttgaaacagctagctaactgtagccagattagctgggcgtgtaagcttttacatcctctatgttatcagtatactgaaggtaatgaggtgaggacgatgaaggcgattattttatatgcatcaatcacaggcaacgcgaaaggaatggctcggattgaacagcagttctttgagcattatggttgggatgtcacgcttggcgaaatgattcagacagatccggcaacgattaaagactttgacgtgttggtgctggcaacttatacctggactggcggcgtgatccctgaagagacccaagacttttatgatgacttaagtaagctggatttttcggctaagccattggtatttggagtgctgggtacgggtgatccctattatggcaaggattataataccgctccggaaaaatttgaagccgttttgaaagctagcggtgcagttcaaggcgcaaccgcggtcaagattgctttaaacgttaaacaagaagagatgcctcagtttgcgacatttacccagcatctgatcaaaaaaaccgaaacgctgcaaaacaagaagtgacccgttggcgcgtggtatactaaagccagaaagcgaggggatcttcatgagtgaggaaattgttttcttcaatcccggcgatgcagttgccaatgatttcgacttcgcagctgctcggcgtagtgcgcagatttacaaagcacagcatgtcgttgatgaaggcttggtagttgccaaagataaagacggcaagtattcggtcttttatgaggctgccggcacacctgattcgcaggctaaaggcgcatacaaagatgttggcaagtatacgatcctagctcacttatgacgaagacagtctggtatcgcgtggccttggtggtagttgctgtcattcttatcggagttctttatggtttaatgcagcaagaacaaatcgcgaatccttttttggttggcagtcttggcttaattctcggcgttgaccttgctttactgcttgccaatctttggcccgtacatcattcgcgcaagccttaaaataatcattcaaaaaatgccaatcaatccgcggccggaaaatttgcgccgtggcttggttggcatttttgcttcgttgaccggtaacttagtcgttgacaatatagcgcggctgcttgcctgacaaaatcgccaaagtgttatccgtaacaatttttgccatggcatcacgcgcctcgactgttgcgttcccgatatgcggggtcaaaaccacattatcaagggcctttagtcctgagctgacatggggttcggcttcgtagacatccagcgcagcaccagcgaggcgatgcgccgtgagttgttcaagtaaggcagcttcatcaatcaagggaccgcgtgcggcgttgatcagataagcactcggtttcatggttgccagtgcctgagcatccaacaaatggtgggtagccgggactaatggcaggtgaagggtgacaagatcgctttgttgcaagagtgtcgcctgatccgtaaaggtggcacctaggctttgctctttttccggtggcagttgatgatgctgcgtgtaaaggatgttcgcatcaaaagcatgaacacgtttggcaactgcctgaccgatctgccccataccgataatgcccacggttttgccggcgagttcatggcctaagaagaaggttggcgcccagccggagaacccgggaccgcgcatgagccgatcgccttctgtgacgcgatgtaaaacggcgagcattaaagctagcgtcacctcggcagttgacgtggttgatactttgggggtgttggtcacgaggacaccatgcgctttagcagcagtgatgtcgatattattgaaaccagcgccgtaatttgcgattagtttcaaatgaggcgcttttgccaatgttgcggcgcttaccggagtcgatagcgcggtgataagcacttttgcatcgcttaaatgtgcctggagctcggcttcggtaatcaagctcttaccgcgataggcttcaaagtccacgcctgcacgtttcaaagcgttgttggccgatttcggtaaggttgcagaaatataaacttgtgccatgaatatccacctttctgtggtcatccgtatctgactcacttttagtttaatacagcgcagagaaaaaagtgtgattgactcgtaacttcgagccaaagaataaccttgttaatatgaagcctgaaaaaaagaggcaagatatgacgtgcacgactcatttgtgttacactgtttttggtaacaaaaagtaagcaaaggggattgatcgttgatggcaactttaacgcaagatatgaaagatatgatcggtgcacagctgaactacttggcgacggctgatgaaaatggtaatccgcaagtcggccctaaaggtaccatgcgggttttggatgatcaccatttgatctataacgaagaaaccggcaagcaggcttggcataacttgcagtattcaaagaaagcagccgtagcaacggttgattacaaagctttgaagggcttccggtttgaaggcaccgttgaatttcacaacgatgatcaaatctttgaagacgcgcaggcttttgctaaggagcgtcatttacctgcagctatcagtgcggttgttatcaatgtcgatcgcatctataagctggatgccggtccaagtgccggtgatttgatcgaaggctaatgccgcgttgatgatatcggcgtgattttaggcttgtaaggcgatacggacaattccgttaatctttttaattagtaaattcataacccgccgttgtgacaaagtgcataacggcgggcttttttgtgtgttgaattaaatactaattgttattattagcatatttattgcgaatgatcaggccggttcgttaagcttaagatagtcagaaagatgtcaaccaaaagaaagggtgagaaccatgatgcatttaatttggacactgattattggtgcggtgattggttgtattggtcagctgatcgttggacgcgacatgccacttggctggatcggaaatattatcggtgggcttatcggtgcatggctcggcacggcgttacttggtagctggggaccatcactggctggtatggctttgattcctgccattatcggagctatcatcgtcgtcttccttgtttccttgttgctgggcacgactcggcgcaaggcataggaggcggcaggatatgaaaccgatcacgaaagtattgttcggtattgttgcgatttgcggcttacttcagagtattggctttggcctgttgctgtggcccaatcgcgaatttacgcgcttttacgtacagcaggccggttggttacgtcctgtgatgattggactaaccgggcttgtgattctggtttttgtcatcatgctgcttgtcgctatcttccgccgctccaccgccaatgctttgattctagccggtgacgatggtgatctgacacttgataaaagtgccatcgaaaatacggtagccaaagcgattgtcgaccggcattttgccaagtcggtggatgttgatgtcagcatccgcaagaagcaagtggcgcggatgcggattgaggccttttccggaaacgtcaaggaactaaaacaagaggcgcagcgtatcgaagaaactgcgcgccagaagttgcaagcgtgtctcggcgttccagtcaaacatgtccgggtacatttacttccagcaacgaaagtaaaagccaagactgcgcgggtcatttagttcaaacgactttgatcgatcactgaccgtcattcaaagcgggtggccgtaactggcaccggtggcagcagtggttatcagctacgaaagggtgatacacgatgcagcaaggaaccattggcgctgttgtcggcgtcatactagcctttgcctggatgcgtttcgggtttatgggcatgttgcttgtcttgatattcggcggtttaggctggctcgttgaacgttatctggtgcctaattgggcgacgttcacaagttggctgaccgcgggtaaagatgcatttagcaaaggaaagtaggtgagtagatggatgcagtagcaccgccaaaaccagcatcagttgcaagtcatcaggaaacactgatggccaacagtcgcttaacatttgaagataaggtcgtcgaaaagattgccgcaatttgtgcacaaaatgttgatggcattctagggatggatggttcggtgatggataacctgactgaaaccttctcaagtggcgagaacctgaccaaaggcatttccgctgaagtcggtgaaaaacaagtggcccttgatatggatgttttcctagaattcgacagcaacgcacaagccattttcaaacaattgtgtgagaaaatcagcgcgcaaattgaacgaatgacgggtttgcagttagtcgaattaaacatgcatgtcaaagatgttttgacgaagcgggaatggcaaaaacgctaatcggcgctaagggaccccataacgcgttcgccagcgcagggatcagcgtgtaaggacctcggttgcaatggtcaaagtgcgaccatcacgcccaaggccgcttacactccgatccttaaacgcgccggttcacactcattttaaaggagagattttaatggacaacaagaaacccaacggaatcaataaggaattgaagttcgatgatgctgtgatcgcaaaaatcgtcgggattacctgcaatgaagtcgaaggtgtttattcgcttgaaggcggcatgatggctaatcttacggatatgttcagcaaggatgaagacccgaccaaaggcgttaacgttgatttgagcgataaccaggacgtttcagtcacacttgatgcaacggtgcgctatggtgagaatgtgccggaaatcttcaacaaagtcaccatggcaattgccaaaaacgttcgccagatgaccggtctgaatgtgacagaagtgaaaatgaccgtcaagaacatgctgacaaaagaagaaattgcccgcaatgaagctaaaaacagtgacaagaacagcgacaaagaattacagccggcttaatgagtcaatatatataaaccggtaaaaagggatagcccatcatccatcgggggctatccctttttgacgttcaagaagcaattttttcgaccaacgcgggtagttctgtcagattcggcagggaataagtcggcgttatgtctggtagtggtgataattgctggcgattaatccatacgcaaggccagccgagtttatgacagggtacgatatcccaccaataccccattgccacgtggagatggggttggttgagtcgggtttcggccgtggtaaaaaaggacaaagtcggtttataacaatgcgtttgctccggtaaaatggcttgatcaacttggtgctccagctggtcaaagtggtgggtcattaaatccggggtggaattggacatgatgatgattcgatgaccggcttggcgcaattgctgcaatgcggggatgacttctggccatggttgtaagttaatataggactcaaataaatcatgaaaataatggctaaatagtgaattggtgtgaaaagtcatatcaagatattgcagatcgcgcttcaataaggtggtgaaaggcaaggtggtctcgccatacatgaggcgatcctcccacgattcgaattggtgccatgcagcctgaccgtcaataccatgacgagcactgaaggtcataaactgggttcgaatggggcgggtgtctagcaaagtaccatagcagtcaaatgtaatatccataaaatcacctttttgagtatcttagcatgatcaaggctgagaacaagtctttaaaaacaaaggtatcgatatattcggcagggtcggggtgtcttcatagccgagaccaatatagtgggttagataatggctgttcttaatagttgcatggcttaactaattgacattcctgccaataactattaaactttttaccaatatcaaagggggaacatcatggaatatttgaagctactcggcatcgtcatcattgttgttggctttgccttaaaatgggataccaccgcggttgttgtgctagcagcgattgtgacagccgtgttttctggtatgagcattccggatttgttgacgacactgggacaaagttttgtggataatcggatggtgtcgttgtttttcctgaccttaccaatgatcggactggttgagagtcatggcttgaaagaagtggccgttaatgggattcagaaactgaagaaattaacgccaagccgaattttgaatctttacttggtcattcgtgaattaggcggcgtctttgggatttccttgtccggccaggttcaatttgtgcggccgttgattacgccgatggttaccgccgcggcagaagcgaaacgtaagctgacggataaggaaatcgacttgattaaagcccgatctgccgccacggataatttcgggaacttttttgcacaaaacttgtttgtcgcaaccgctggcgttttgctgattgctagtacgatgaagagtctcaagcatccggtagagccgatgcaggtggtgctggcatcaattccgatcgcgattatcaccttggttgtagtggcggtttataatcgctggtttgatcgacaatttgaagaaacgccgcgcaaaggaggcaaaaagtgatggtcgacacgttactgctcattctttatgcactcatcggcgttgtcatggcgattgccgggattgaagccttccgtgcaaaagacaacccggctcgaatcggaaccggcctgttttggatcatcatggcgattgtttttgcgttcgggacgctattaccggcaatggtcgttggtattttggtcgttattatcggtattttggccttattcaagcagattcaaatcggcaagatcaagccggttgacggtgcgcatgcggctcaggcagccaagcgacttggcggctgggtgtttgttccaagcgttgtactggcgatcgtttcaattgccgttgcccagtttaccaagttaggtgggcaggtcgggatcggcattggcgcggcggtctcattgattgtggcgatcatcatgaccaaggcacccgtcaaaatgatttataatgatacccaacggatggtacgatcagtcggtgcagccggtattttaccgcagttattggcaacattaggcgctgttttcacagctgcaggggttggcactttaacggctaagttgattgcgggtctatttccggcaggcagtcatcttggcggggttattttgtactgtgtggcgatggcattattcacgatcatcatgggtaatgcgtttgctgcctttgccgtcattacggcggcgattgggattccatttgtgattgcccaaggtgctaagaaactgtttgaggtctttgaaagacgcttgaatttccggtaaaatatgtgaaaaaaggacttcattatgactgattatccaagcaatatcactcgtgaccaatttgaattgattcgcgttgaccttgagacgtttcgcaagcgtacatgtcctcgaagggtggacctatttgatgtcttcaatgcagtgctttacgagcttcgtacgggcgctcaatggcgtcagttgccgcatgattttccgaaatggcaaaccgtttacacttactttgccatgtggtcaaaaccattagctaattcggaatattccctgattgacctgcttttaaaaaaattgtcgctcgagagcgattacgaatgggacgatcggtacgaacgtcgttcgtaattcttgatgcgcaaagcgtcaaaaatacggcaacaccccaaaataaagggtatgatggcggcaagaaaatcagtgggattaaacgccaccttgccgttgatattaatggtctcccattcgcgatccacattaccacagctaatgtctccgaacgggacggtgcgatcgctttactcgcgttaaatgaagagcagtttgatcttgttcagcgagtgatggccgatggtggctatacaggcgacaacttcgcccagtcggtccatgcaatcattggtgcagatgtcattatcgccaaacaaagtgatctgaagaacggtcaagtaacgccacagcgctgggtcgtggaacgtagtttcagttggttaaccaactggcgacggcttttgttcaattgcgaacgcaagttaaataccagtaaagtcatggttgctatggcctttatagggatcctgcttgctcgtcaatagagacctcaaacagcttctaatcctgcgatcgttgcggccattgggatgacttccggttattgcggcaccttattgacccctatggcagcgaatttcaatagtttaccggttgcgttgctggaaatggaagatccattgggcgtcattaagcagcaggcacccatcgcgatcctgcttttggtgattcaaatcggactgatgtatttcctggcgttttagaaaggacgattaagcatgaagattcttgtgacaggttttgatccttttggtgatgacaagattaatccggcgattgaagcggttaaacgtttgccagatgaaatcggcggggccaaaattgtgaagttagaaattcccactaaattcaatgtttcggcagaagtggtgcatgatgcgattgttaaagaaaagcctgattacgttctgagtattggtcaggctggcggacgttatgaactgacgccggagcgagtggccattaacttggatgacggccgcattaaagataacgctggctatcagccgttaaaccatacgatccatgaagacggcgaaaacgcctattttacgcaattaccaattaaagcgatggctaaggcaatcagagaagccggtgttcccgcggcggtttcaaatacagccggcacctatgtctgcaaccatattttctatcaagtgcagtacatgcgggacaaggaattcccaacgattaaagcgggcttcatgcatatcccgttcttgcctgaacaagttgttgcacggccagagactccggccttgtcgcttgaagatgacattaaaggcattaccgcagccattgccgccatcgtcgcacatgatggcaaaggcgaccttgaaaccgttgaaggcaaaaatcattaattgaagattcacgttgatattttccgcaagctcactagggcgtgcggattttttaatggccgatttttccgttttctccgggtgggcgatataataaaggcagagataaggacacggatacatcctcagtttggcaaagggaggttgtgacaacatgagtatcggaattattggatcaggtaatgttggacgcgcgttgggacagctttttagtcatgttggcgagcaagttattttgtcgcatcgacatggggtggcatcactggctccggtgattgcggagatgcgatcaacagttgaagcgggtacagttgccgaggcggccaatcaggatattgtcgttttggcagtaccgttcaatgcgttagacgagctgccggcgcaagtgaaagctgatgccgtggtgattgatgctacgaattattttcctagccgtgacggcgaacgagctgacttgacgagccatcaaatcgcttcatcgcaacttgtggcgcaacactttgggactaagaaagtcgtcaaggcgttcaatacgattgcgatgacgaaaattcgcagcctggctaagccgaatcaaccagccgggcggattgcgatccctattgccggggatgatgcaacggcgaaacaaacggtggccgcattgattgaaaagatcgggtttgatgttgttgatcttggtgatttggccaacagctacccggctcaagcagatggcccgttattcctgttcaccggtaatgctgatcaagttcgggcgcaggcaaataagtgactgcagcatggtagttcactttgcacacaggagaaaaaattgatgattttcttttatggtattttgttcatcatcgcggtgactttcttgtgggtgattagcaccaatgagtacgcgcaattggttcagaaaaaaagtcgcggccaagggcgtttgtttcggccttgttgctgggctggatgagtatttttgaaaagccgctcgctgcaattgaagacatgataatcaaaaatcggccttagtggagaaggtctctcacactaaggccgatttgtttggggttattttgttactggcattaacgctgtctctaattttgatatgtgctcattgtaccggctgaccgatacgctttttgtgatttgccacaatcattttggcaatggctttggcgatgttttggttcttaaggactggaccgtgtgaataactgccgatcgtattcttatagcgcatgccttcaacaccgtcttccggattgttaccgtagccttcgatcatctttcctagaggttttagcttatttttgtcgtcaaaataagttcggccgctatggttttcaaatgccttgacggtaccgaactcggtttcgtatttggtgtcgccgatcatacgactgtccggtttgaagacggtatgcagcggcaaaataccgagccctttaatgaccgtcccttcactagtcttgtaatagtcaccgagtagttggtagccgccacagatagccagcatcggtttgccattttcgatgtagcggcccaaggtttgggcatagcgcagtaaatccttggcgacaacggtttgttcataatcctgaccgccgccaaagaaaatgaagtcgtagtcatcggcattgaagtcgtcaccaagactgatgttatcgacttgtacttgatagccttgttgattcagcaagtaacgcagaattttaacatccccgctgtcgccataagtgttcatgagatcctcatacaaataagcgattttgatcgtatcagccatggaccgagcgcctccgtttttttgattggcaacagcttaccacaagtgaagggaaaaagagaagtgagctgattgattggtgctgaacaattaaagaaggcgggtaaagtatcagctggaacaacgccagactggtgctttatccgcacttagttgccctgccatatgaatagcaggatttaacgtttatgtgccttgatccaaggttgagccttttcctcaatcgcttgataaattgcatccatatccgagtagtcactgatctcaaacacgaattcatctggctgatcgtgaaaagtcggcttgttgtttaaaatgatgttcagctggtcaaattggttgtcaccagtatctttgcgaatttggtatgtgaaaaacgctgcttcataatcttgaatattgtcaggctcttcgtacaacacttccataaactggtggtcagtcttgtagttgtccttttttagcttatcccacagcgcctgatactgctgatgaagttcagttaactgagcatccgttaattgttcgttttctttaatttctttaccgtctaattccatttttttcgcctctgagttgaattacttccttattatcgaactgtgtggggggattgtcaaaagtaagcgcgagccggcgcggttagaagccggagcataagtggccttgggcgtgatggccgggctttggccattgcgtccaaggtccttatgtgcaggcttctgcgccggggagcgcgttatgggagtataggccaactctttctcaattctagtataattaagtgatttccgttactccgagctggctacgcggtggcaggctggcgaccgcgtagctaaagtggtgggcacgactttgaactcgcaaagtgcggttttcaaagctcggccttggtctaaagcggagaagcccactccgcttaagaccaatttcaccactgagtccgccaccgctccgccagttcttgctttccatccaattatccaaacaagatactcaacatttgtcaggtaatatccaagatggctcgacttctttaacgccagtgaaaactaattgtcttgtttcaagtcgacacttacctcactaagaatacagttgagcagacggcgcttttacgttacacttgacgggtacgtgaaaccctgtttgttccacaaaatcaaacccaaaaaaacggaggcagacatggatccaacagcttttgtccacgccttggctgatcacggtatcgtgttgaatgaccaccaacaggatcagtttgcggcttactatcagtatctgatcagtgagaacgagaaaatgaatctgactggtatcactgctgaaggggacgtctacctcaagcacttttatgattccctaacattaggcttggtggtgccaaaattgcaaagccagccattgtcgctgtgtgatgttggcgccggggcgggttttccatcaatccccttaaaaattgcgtttcctcagttgaagatcaccattgtcgattcgctgcagaagcggattggctttttggaacgtttaacggcgcggttagagttgaccgatgtgcagctctttcatgatcgggccgagacttttggtgccaaaaaatcgccgcaccgtggccagtatgatctggtgacagcacgcgcggtggcggcgctgaacgtcttagcagaactctgtttaccactcgccaagcagcacgggcagtttgtagcgatgaaggccgccgcaactcctgaagaattaatagcggccaaaccggcaatcaacctacttggcggtaaactcgttcaggatgcagcgctgaccttgccggaaaccggggatacgcgccatttgttagtgattgaaaaagttaaaccgacaccgaataaatatccccgaaaaccgggcatgccgaataaacaaccattgggaggtgcatagcgcgtggcattatcattttttggccataaaaagtcagatgacgagacggtcgtgcaacaattaccgcttaaagctattgtccccaatcaatttcagccgcgaaaagtttttacttccgaatccattcaggaattagctgctacgatcaaagaacacggcttgttgcagcccattattgtgcgtgaatacgcgccagatcagtacgaaattattgccggagaacgacgctaccgggcaatgcaactgctggggtgggaaaaagcaccagccattgtgcaaaagatggatgatgatgaaagtgcgtcaatggctttagttgaaaacctgcaacgtgaaggtttaagtgcgattgaagaaggacaggcttatgttgcgctgatgaaactgaatcacctaacccaaggcgcattagcccaacaattaggtaaaagtcaggcttttgttgccaataagatccggctgctgaagcttagtgcgccggtgcaagaagccattatgaatggtcaaatcagcgagcgtcatggccgtgagttgttaaaactcgatgaatccgaacaagtaccagccttacaacaggtttttgcggaaaaactgacagtcaaggaaacggctgcgttagtaaatgaacggttgcgcccaaagaagcccacaccaaagcctaagccaaaagttcggcgatcagcggtgagtcatgatacccgcatcgcttggaacacgttgaaacgttcggttaagatgattcgggatacgggaatgacagtcacggccaaagaagaagataccgatgacgcataccgtatgatcatcgagattccaaaagagaagagataggaggaactcatgacacatatcattgctgttgccaaccaaaaaggcggtgttgggaaaacaacaacgaccattaatctgggagcgtgtttggctaaccttggtaagaaaattctgattgtagatgctgatgctcaaggcaatgcgacgagcggtgtcgggattcaaaaggcccaagtcgaaaaagatatctatgacgtgttagtcaatgaggatccgattactgaagccattttaccgacaaagcacaagaatctttttattgttccggcaacgattcaattagcaggagcagaaatcgaattaaccagtcagatggcgcgggagatgcggctaaagttaggcttacacccggtggcggatcagtacgactatatcttgattgattgtccaccatctttaggccagctttccatcaacgcgtttactgcaagcgattcgattttgattccggtacaaagcgaatattacgcgttggaaggattgagccaactgcttaatacggtgcgccttgttcaaaagcatttcaatccaagcctggcaattgaaggcgttttgttaaccatgtatgatgcgcgaaccaatttaggggcgcaagtgattgatgaagtgcgcaaatattttggtgataaagtctatacaaccgtgattccgcggattacccggctggctgaagcgccaagttatggcctgccgatcgtggattttgatccgaaatcacggggatccgaagtttacgaggcattagccaaggaggtgctggctgctcatggcgaataagaatagtaaaggactaggtcgggggatcgatgcgatcttcaaggattttgaaagtcccgatctaagtgccaacaataccgttgaggaactgccgctggtcgatatccgtcccaatccctaccaaccgcgtaaaacctttgatcaggaaggcttaaaagaactagctgattcgatcaagcaaaccggggtttttcagccgattattgtgcgcaaaagtgtttcgggttacgaaatcatcacaggtgaacggcgctttcgggcgtcaaaactggccggcaaggaaaccattcccaccattgttcgcgattttaacgatccggaaatgatggaaattgccgtgttggaaaacctgcagcgagaagatttaaccccgttggatgaagcacaggcatatgatacgttgatcaaacgcttaaatctgacgcaagcagaggtctcagcccggctaggcaaaagtcggccctacatcgctaactatctgcggctgttgacgttgccacagccggttaagcagatgttgagcgccaatcagctgtcgatggggcaagcccgaacgctgctgagtcttaaagataagaccaagatggtggcagttgctaaaaagacaatcagcgaaaatctaacggttcgtcaacttgagcggctcattaatcaaatgaatgccggtaccaatcggccagcgaccaaggaaaaaccgaagtcgccgtatgtacgcgcaaccgaaaatcagttaggtgagcgcttcggaaccaaggtcaatattaatgaaggcagtaaaggcaagggcaagatcgaaattgattttagctctgaaaaagacctgaaccgtatcttagccatgcttgacgtcaatattgattaactggcaaaacagttggaggtgggcgcatgtatcaactacatgatctggtgcaaatgaagaaaccgcatgcgtgcggcacaaatcgttgggagatcatccgcttaggggcagatatcaaagtacgttgcaccggttgcggacatatcgtgatgatgtcgcgccgtgattttgagaagcgactcaaaaaagtgttgggtcaggcagaacaaacagactaaatagaaagtgtgaaataaccaaatggctttaacagcaggtattgtcggacttcccaatgttggcaagtccacgctttttaatgcaattactaaggcgggtgcggagatggcaaattatccgtttgccaccattgacccgaatgttgggatggttgaagtgccggataaccgactggcacgcatcgatgaactgattcccgctaaaaaaatcattcatacgacttttgaattcaccgatattgccggaattgtcaaaggtgcttctaaaggggaaggactgggcaacaagttcctggaaaatattcggcaagtggatgcgattgttcatgttgtccgtgcgtttgatgatgacaacattaccagcgtcaccggtaaagtcgatccgctagaagatatggccaccattaatatggaactggccattgcggatttggattcagttaacaaacgctatgccaaggtcgaaaaagtggcgcggacacaaacaaacgataaagaagctcaggctgagtttaaagtgttgcaaaaaatcaagccagtgctcgaaaacggcggcatggtacgcagcatcgactttgataaagacgagcaaaaaattgtcaaaggcctttttctgctcacgagtaagccagttttatatgtcgctaatattgccgaagaagcgatggctgatccggattcagtcgactatgttaagcaaattaaagccgaagccgctaaagaaggtgccgaagttatcgccatttccgccaagactgaagaagaaattgcggagttggacgatgacgaaaaagctgactttttggcagcggaaggcgtggatgaatctggcctcgataagctgatcaaagcgagctatcatcttttggggttggcgaccttctttacagccggtggcaaggagactcgtgcgtggacattccgtcgcggcatgaaggcgcctcaagtagccggtatcattcattcagacttcgagcgtgggtttattcgggcagaaaccatgtcttttgccgatttggataaatacggttccgttcaggcggttaaagaagccggacgttatcgctccgagggtaaagaatacgaagtgcaagatggggatatcattgaattccggttcaatgtttaagctgactggtcaaataaggcccgcagtgatgatgattttttaagataggagtttcaaatggcagaaaagcatgaagcagacacgagtcaagcggtagacagtgctgcagttgatcaacagcaagcagcaggcggtacttctgaagcttcgtccgcaaccgatgcggcaagtaagaatgcccatgttaaacaggtgcggccggcttcaacagttccggaaatgattgaacaactcaccaaaaagaatgatgagtacgtgttcaagttgcggcgtgaattgaaagatggcggcatgtctgcaactgatgaagagaccttacttaagacgatgttgccggaaatgattacggcgcaacgtcaaggcaagcccgctacccagctatacgggccggtaacggtgaaggcaaacgaaattttgcatacgcccaagcctgaacccaagaagccaatgtggttactgattgtcgatcaaagcctgttctttatggcgattttggcggttatgtacggtgctttggcctacttcaatcccaagacccagaacacggctactagcggttttcttagcctcttgctgctgagttttatggccggaattttcttcgtgtactacgccgactggatgcaaaaagacaagaaagaacgccgcagtgcctggttggttcttggaggcggcgtcttattggtcgttgcggttaccttcctcagcagtgcgcttgcgttgctcaatacgccgctgactcagccgatgccatggtttgccaacattatcgttggggttgttgcttacggcattcactgggtgttgcagcatcggtatcatctcaagagctttttccaacggtagacttgggaaatcaaaggttgtggttcttgaacaactaggctcaataaactcaacgggtgctagaagacaggatgcatatgtcttctagtgtccgttttttctttgctgccaaaggaaattaagcgtgagtagcttgaaaactaaacgcctcggagctaatgccgaataataacaggtgattttatgagcatgattgcaaaagacgaacattaatttcgcaaactggcaaccgtttttattttgttcgggtcttaatgaacaattatgagattttctttcatttttaagcctatgataccggtcttttcaaaaaaattaacgtctacgtttgacgaggccaatttccggtagtacattagtcaacaactaaaattgaaagagggatttacgcaatgagtaattgggatacaaagtttgcccggcgtggttttacatttgatgatgtgttgttgatacctgcagaaagtcatgttttgcctcacgatgtcgatctgtctgtacaacttgcggacaatctaaagttgaatatcccaatcatctcagcggggatggatacggtgaccgaaagtgccatggcaattgcaatggcgcgtcaaggcggtttaggtgttatccataagaacatgagcattgaggctcaggctgatgaagtgcttaaggttaagcgcagtgaaaacggggtcatcgttgatccgttcttcctcactgctgacaagccagttagtgatgcggaagcgttgatgaagaagtatcgcatcagcggcgttccgatcgttaataatacaaccgatcgtaaactgaccgggatcattacgaaccgtgacttgcggtatgttgatgataagagcgttctgatcgataccgtgatgaccaaggaaggtttggtcactgctccggctggcacttcaattgaagacgctgaagccatcctgcaagcccgtaagattgaaaagttaccactgattgataagcaaggccggctcagcggactcatcacgattaaggatatcgaaaaagtggtagaattcccgcatgccgctaaagatgcacatggtcggttgttagtcgctgccgcagtcggggttacctcggatacgtttgaacgggcccaggcgctgttggatgcaggggttgatgcgattgtcattgatactgctcacggtcatagcgccggtgttattcgtaagatcaaagaaattcgcgaacattttccattagcaaccttaattgccggaaatgttgcaacggcagaagcaacggaggcgttgtatgacgctggcgttgatgttgtgaaagtcggcatcggccctggttcgatttgcacgacccgaattgttgccggcgttggggttccccagttgaccgccgtttatgacgctgccagtgttgctcgcaagcgtggtaaaaccattattgccgatggtgggatcaagtattccggcgatattgtcaaagcgcttgctgccggtggtaacgccgtcatgcttggctcactcttggctggtaccgatgaagcaccaggccagtttgagatttatcaaggccggcgctttaagacgtatcgcggcatgggttccttgggcgcgatggcacaggctcatggatcaagtgatcgttacttccaaagcggtgtcaatgaagctaacaagctcgttcctgaagggattgaaggccgggttgcttacaaaggcagccttggcgatgtgatcttccagatgcttggcggcattgaatccggtatgggttatgttggcgcaccgaacttacaagaactacaggataatgcgcagttcattcaaattaccggcgccggattacgtgaaagccatccacatgacgtccaaatcacccgggaagcaccaaactactccgttcaataatcaagatattcagtttaagagcttgcagttacccacttgaggcagctgcaggctcttttttagtgagcgcgagccggcgcggttagcaatcggagtgtaagtggccttaagcgtgatggccgggctttggccattgcgcttaaggtccttacacgcagattgctgcgccggggagcgcgttatagaaagcgagcgtgaaccagcgcggttagggatcggagtgtaagtggcctcaggcgtgatggccggtctttggccattgcgcctgaggtccttacacgcagatccctgcgccggggagcgcgttatagaaagcgagcgtgaaccagcgcggttagggatcggagtgtaagtggcctcaggcgtgatggccggtctttggccattgcgcctgaggtccttacacgcagatccctgcgccggggagcgcgttatagaaagcgagcgtgaaccagcgcggttagcaatcggagtgtaagtggcctcaggcgtgaaggccggtctttggccattgcgcccaaggttcttacacgcagacttctgcgccggggagcgcgttatggtaatcgcgagcaagacagttttaacgtgcgagcttaccgtttttgataacgtgcccgatgaaaagcggtcagtatcggtgtgccaaaagtggtggctattgctaacggccaaggaacggggcgctccgtggtcgccaacaatgtttgcagccattgcgcagtcggcagtagttttatcaaccgatgactggaaaactgggtgaataacagattttcactataaaaatggatcagataccgctgtagaagcgggtcatggattggcaacagcagatcgttgctattattgcgattacccaaaaacagtggcagtcccgcgaagtcgcgttgtaaatcagatgtccggcttttatgagcactggccattgccggcgtgagtcgtaacatgaaaaccagtttatgtgctgctgcccacaacaacatattggcaatagcagcatcggttgccgtgaaattgaaagcaagctgctgtgctgcaggactggcgaatgcttggcgtagctgtgactggagctcagtagcggtttgtttatctgaataaagcacctgcagctgccgaacaccgcgcagccaatgaaggtgggttgccaagcgtagggtcagccattcgtcttggtggtgaagcagccaataggtactaccgcttgaatgggcaatgttaataccggcaatttgcatcgtttgcggcaaactggcagctacgagggttgttaattttggcaaaagaacacctcccacctgaaatgcaaagcacgcatggcgctcgttttcttagggttttcgtaaagaattcccggttcaattttggtacaatggacagtgatgttacagtccctaacgattgccgtataaatggagtcaaaattatgaagatattaattgtagacgatgataaagaaatcgtcgaactattgagcatttatgttaaaaacgaaggctatgaacctattcaagcatactcgggcaaagaagcgattaccaagcttgtgaccaatcccgatattgcgttaatgattttggatattatgatgccgaatatgtcaggcatggatgtggttaaggaagtacgcaaggattcgcaaattccgattatcattgtgtcagccaaaacagcagatatggataagattcaaggattgatcaccggtgctgacgattacgtcacgaagccatttaatccacttgaggtgatggcgcgagtcaagagtcttttgcgtcggagtcaaaatgaggtgaccaattcggagccggatgtgctggaagtcggtcctttgacgatcaaaaaggatagccacgaggtcacaactttgaccggcaaacagattcagttaacggctttggagtttggaattctctacttgcttgccagtcacccgaatcgcgtcttttccgctgacgagatttttgagcgggtttggcaacaggagtcaattgtatccgccaagaccgtgatggtgcatgtttcacacctgcgtgacaagattgaagaggcaacagatggtgagaaagtcatcgaaactgtctggggcgttggctacaaggtcgaggcctagttcatgagcgaaaaggtcaaactcactggtaaggaaaagtccgagttgtggattgaaggcattgtgacagttattttgttactgatgctgaactttgcgttgttagtgctgattaatcagatgattgcgcataatcccgggttggagaatgcaatctggggtgtgaagacgaatttgacttttggccgcggcggttttcatctgtggagctggtcgaatcttttccttaccttgatgggcattgcagacgtcattgtggtgtactggcgattggcacggcgatatcggcagatgcagatgcgccacgtgattgcagagttgcattatattgcggatggccacttggatcaccgaattaaatttgaggtgaataccgagctgcaaaaagtggttagcagcattaatgcgctggttgattctaccgtgaactctatggaagaggaacgacgaatcgaacagagtaaagatgagctgattaccaatgtcagtcatgatatccgcacaccgttgacctcgatcattggctacttaggcttgattgaggatcatcaataccgaagtgaagcagagctactcaagtacacgcacacagcgtatttgaaagcaaagcagatgaaggttttggttgaagatttgtttgagtataccaaggttaaatcaaccacgaccaagctgaatccggtccggttcaatatgattgcgatgttggaacagcttgccgcgagctttgagttggaagcccataagaaacacatgcggatcctggtcagcggcgaaccgaacccattaatgatggaagctgacactgaaaagctgggtcgcgttttcaataatctgatcgtcaatgcgttgaaatatgggcaaggcggacggcacattttccttgacgcccagcggattggcagcgaagtcgtcgtgaaggtttcaaatgatggggctcagattcccaacgatgccttaagccagttgtttgatcgcttttaccgggtagaagaaagccgctcccaagaaaccgggggcacaggactagggttggccattgcgcaaagcatcattgcgttgcatggcgggtatatttacgcagattcaagtcctgaattaaccagttttgtgattcatttaccattaaaagttggcgcttcgctgacggataaacaaactaaatctaatgaggaagcaggaaagacgaaatgaagaagttgttacgtgggttggttgccgcaatggtcgcggtattaatgataggcggtgctgctccagcggtgtccgttgcagctgccgaaagcagtgatacaaatctggttaatgccaaagccgcggttgcaattgagcccacaactggcaaggttttgtatgctaagaatgcaagcacggttttgccgattgcatccatgaccaagatgatcagtattgagttagttctcgatgccattaaatcaggcaagatcaagtgggacgacaaggtgacgttggatcagtcgatatggacaattagtcaagaccgtgatctcagcaatgtgccgctgcgacgtgatggctcatactcagtgcgcgagttatatgatgcctcgctcatctactcagccaatgcagccatgatgttgcttgcaaaggcagtagccggcagccaggagaagtttgttaatcaaatggatgccaagctcaagagctggggcattacagacgctaaaattgtcaatgtgacaggactgaataatagtcagctgaaagatgccaaagtaccaggtactggcgacaatgcggaaaacgaaatgtcagccaaagatatggcacaagtcgcgcaacacttaattaaggatcatccggaagttttaaaaacaaccagtattgccaggcagaccttccgtaaagggaccgatgatgcgatcaatatggaaaactgggattggatgctcaaaggtttggtttcctacgataagaacctgccagttgacgggctaaaaaccgggacttccgatgcggctggcgactgctttaccgggacggttgaaaagaatggcatgcggatcatcaccgtggtgttacacgcaaatggcgatgccaagacacggcggtttgatgaaaccaaaaagctgatgacccatgttctggaaaactggaagaccataacgcttgcgaatgccggccaaagtattaagggctacagtaaggtcaatgtcaaccgtggcgcatcacggacaacaccgattgcaccaagcgcaaaagccgttgccgttgttcccactgatgcaagtaaaaagacacttaagtatacttacacaccggctaagggtgtcaaaaagaacacaattgaagcccccgtcaagaaaggtaccacgatcggtaatttgaaggtaaccgcaaaagacgatcaacttggctttgtgggtgataacgcacaagaaggcattacccttaaaacgaccaagtccaatcagaaagctaatttctttgtcctgattttccgtggtattggtgatttcttcagtcacattttttagtcggtactgctgacatcatgaggtgaatgttttggactcccggttggaggtcaacgcgttcgccttttttgtgagcgcgagccagcccgtttagaaaccggagtgtaagtggccttagccgtgatggccgggctttggccattgcggctaaggtccttacacgcaggtttctgggctggggagcgcgttatggtaagctgagcgcgagccggcgcgcttagaagtcggagtgtaagtggcctcaaccgtgatggccgggctttggccattgcggctaaggtccttacacgcaggtttctgggctggcaatcgcgttatgatggaacaggatcacgaagcactgaatttcatgggaggcttgtaacatggtaacgtatcatgaaattaccccggctggtttggctaatcttaaacaagaagttgcggatctcaaggcgattcggccagctaagattaagaacctggctgaagcagcggctttgggcgatcgttcagagaatgcagaatacagcgccgctaaacgcgaattacggcagttagagggtcgcttgcgatatttggacaagttgattcggtatgccaaagtgacgacgccggccgcggccaaccttgctgatatcggtaattgggtgacacttgaatttgacgatgatcaggatgaagacacttatgagttggtcgggccagcagaagcggggatgggggcagctaaacttgccatcaactcaccactgggagcagccgttcgtcgccatcatgttggcgatacggtcaccgtcacggcaccgagtggcacttatcaggtaacggttatggccattagtccgcatgcgcccggtaagtcagtcgagcagcacgactgagcaaactcctcgatttatgggcggaaatttccaatgctgatgcgaggatcatggtagccgtaaccgaatgtcagaagagcaagcacctgaggcgtgtttttcatcatggtttcaaatagatcaagatgaaagctgccacagtgcttatgctataatgaagcttgaattcacggcatataaaaaggagtagcagcccaatggcactatcacttagagcttgtattttattattaaaggaacatcacttattaaaaagtgcggcaattcagaccactgaagatgtcgatatgaccggcattgcctatgattcacgaaaagtttccgggccgactttgtttttctgtaaaggagacaaatttcggccgatttatctgtccatggccaaagataacggcgccagaacctatgttgccgaaaagccttacgtggaaggtaatggtttaaatgccttaatcgtccggaacatcacgaaagcaatggcgattctcagtgcggcctttttcgattatccgcaagatgatttgtttgtgattgcttataccggtactaagggcaaaacaaccgccgcttatttcaccgaggcgattttgaatgaggctcggccacggcacatcgccttgttctccaccattgatacggtggttggtcccgagccggatcaacggttcaaatcgaacttaaccacaccggaaagtttagatttattccgggatatgcgcgaagcagttgaaaatggtatgacgcatttggtgatggaagtttccagtcaggcttatttacgtaatcgcgtctttgggctgacttatgatgtaggcttcttcttaaacattacccctgatcacatcggaccaaacgaacatccgacttttgccaattatctgcataataagctgcagttgttggtcaatgcgcgcaaagtagtgattaacgcggaaaccgagcattttgatcaggtctatgcggcagcgaccaccacgacttatccggagagtatttatttgttcgccagtgctggattcaagcctaagcgcgatgacattgatattgatttccgatttgatagtcaagaagctgatgtcgccgaaagccgctttacgttggtgccggtaacggaaaaagcagcggcgcttaatattggcggccattattcgcttgctttaatcggcgacttcaatgaaagtaatgcgacagcagcgattatcggcgccggcctggcaggtgtggatgcatctgctgcggtgcctggcatcgccaaagtcaaaattccgggacggatggaacattttcaggttccgggtcacggtacggtttatgtggattatgcccacaattatgctagtatgaaggctttgttatcgttcctgaaacgttcctacaaagatccgcgcttgctggtcgttgtcggctcccctggtgataaaggggtttcgcggcgcccgggctttgccaaagtattaactgagttggcaacagaagcctttttaacaacagatgatcccggctatgaggatccagccaatattatcaatgaaattgaccttaagattgatcacaccaaagttaaggttcacaaggtgcttgatcgtaaagaagcgatcacggaagcgattaaggctagtggtcccaaagatgttgtggttgttgccggtaaaggcgcagatccgtatcaaaaaattcggggcgtcaacacaccttggccgactgatatggccgttgtcaaggaagtcgcccaatcgttacaggaaggctgatttgaatgcgtcaatttttcaccgttattggtggcatggggacaccggcaaccgagagttatgtgcgtctgctgaatcaacgcacgcatgctcatagcgatcaggaatatctcaattatattttggtcaatgatgccacagtgccggatcgaaccgattatattctggatcacagtaaaccgagcttcttcccggatctactagaagacgttcgggcacaaagcctgttgcagcctgaattcatcgtaatcgtctgcaacacggcgcactacttttatgatcaattagctgctgcatcgtctgtgccactgttacacatgccgcggctggccattcgcgatatgtgcgagcgattcccgaatgaggagcggatcggtcttattgccacccaaggtacgatcaaagatggcatttacagtcatgaaatcgaaaatacagggcgcaaggttattttaggagatcaggcgttgcaggacatggtgacagagctcatttataagtacgtcaaagaaaagggcgaagtcaatgccgagttatatcatcgcatcttgaaacggatgcacgatgattttcaggttaacgtcattgttcttggctgcaccgagctttcgtttgctcaggaaaaagccggtgatcatccatatcatgtgattgatgcccaaagtattatcgtggacaagaccattgcactcggtaaggcttttcggaaaagtgaggcaacgggtaaggcattgctgaatcaaatgatggtgcgttagtgtgccggaaaaaggcgtcggaagtagctggttcatatcagtaacttccggcgcttttatgactataggcatcgagcgggtcatgcaaaataatacttacttgtggtaagctttaaatagtacccaataaaggagatggcatattttggcacatttaaccaaattaactgacacatataccttgagcaacgggggcaagattccaatcgttggttttggaacttggcagacaccggatggggaagttgccaagcatagtgtggaagctgcgttggctgccggttaccgtcacattgataccgcagctgcctatggtaacgaagaaagcgtgggtgccggaattaagacgtcgggcgttgcacgtgatcaaattttcttgaccacgaagctttggaatgctgatcacggttatgacgcaactaaggcagcgattgaccgttcgcttcaaaaattaggtgtagattacgttgatttatatttgattcactggccaaatccagttaagttccgtgacaattgggaagaggccaatgccggctcttggaaagcgatggaagaagcttataaagacggcaagttgcgggcgattggggtttcaaacttccgcgccaagcatttggatgcattgctgaaaaccgctaatgtcaagccgatggtgaaccagatcttcttaaatcctagtgatttgcagccggaagtggttgcttataatgatgcgcatgatattttgagtgaagcatacagtccactgggtacaggcaagattttccaagttgacgcacttaagaagattgccgcacggtataacaagagtgttgctcaagtcgttcttcgctggtcgctgcagcatggcttcctgccgctgccaaaatcggtacacgatgaccgcatcaaggaaaatacccagctctttgactttgagttgagtcatcatgatatgacgttaattgatgctttacatggtgaagctggtttagcgacagacccggacaccacgaatttctagcgttaagtcgtcaatcatgattttttgcgattaagtacacgacagctgtcaggtcgatgacaattaaataatccagcattaaaaaattcccgcaaacgctcattgcgggaatttttttgccaaataagtgcgtgcggctggcgatggcgaactgtattaaggtagggtcttagcgccggttttggcattgattagctggatgttgttctcggttaaaaattcgtggtacttggcggcgatatcgccataagtgacaatcgcatcgatatcttgcacggtaccatatgtgagcaacgatacccggccgaatttcgattgatcaatcaacagaattttgcgatgcgccttcttgaagatctccgacttaattaaatattcgttgtactccgagttggataatccgcgagtgagcgaaattccggttgctgccataaaggctttaccgatattgaaccggctgaaaatgttcatgttatcaatgccggtaaacgattgggtgcggcgatcaaagttcatgccgatgatgacaagcttaatattggcaagcggcgcggcttggttgatgatttgaagattgttggttaccaacgtaaaaggaaaatcggtcggcagaaattcgcccatctccgcagtcgttgtgccagagtcaataaaaattaagtcttcaggttcaatcaactgtgcggcagcccggccaatttgtcgtttttcgctgggtgcggctaattgacgctcgctgtaaacggtgagcggattgtcctttgtgctatcgggagtggttgtgaccccaccatagactttttttaccgtaccgtttgaaattaaggttgctaagtcacgccgcaaagtgcttggcgcaatcgagaacttatcttcgagctctttcattgacgcggttttaacttcgctgatataagcctgcatcgcatcaattcgttcttttctaagcatgaatgtcaccttctttaagccgtcttcgctaatctgattatagcacgttatgaatatattttggacatattatgaccatgttttaagctcgatgccgaagcatatagcagtaacctgatttccgtagactcgttgataagttggaacgtcatccaaagcgagtcatttggggagctcgtgaaaaaatagacatcactcgtgaggctagcaagtacctgactagttacttttatcatatcattttactacatgccacttcatttattttggcgaagtcgctcacaagtgaacatctaatgattaaattatgaacactttttagttgactttgaccatatctgcttatatgatgacaatgtaatcgaaaagtaagcgcttaaccgatacgtggaaagactcttgaaagtttggaggttaatagcatgcgtaaagcaggggttgttagtaacaaaggcgatgctgcactggctccccagccggatttgggggttaaatccgaaaaattgccaaaatcggctcgtcgtcgtttgcgggttatctcgattatcgcaacatttggcgggatgctttttggatatgacactggggttatcaacggcgcgttaccgtttatgaccagagcaggcgaactgaatatgtcgccttccatggagggcttagtggccagctcgttaacattgggggcggcctttggtgctgttttgaccgggcgcatttcggatcggcgtgggcggcacaaggtcattaccggacttgctatcttgttcgtcgtttcgaccatcgcctcagcattatcaccgaccgcaccaatcttggcgtccgtgcgcttcgtcttgggcttagcggtgggcggtgcttcggttattgtgccaacatttctagctgaagtcgcaccctcgaatcttcgcggacgaatcgtcacacaaaacgagttcatgattgtttctgggcagttgttggcgtttgtgtttaacgcgattttggggacaacgttaggtcatattcctggcatttggcggtggatgcttgttttggcaacggtgcccgcagttattttgtggattgggatgaattttgttccggaatcgccgcgctggttagccgctaatggcaaattggatcaggcgttaacggtgttgcggcaaattcggacagaagaccaagcgcaagacgaaatggaaaaaattcgaatttccttaaaatcggaacaagaagtgcaaagtgcctcgattaaggatttaaagattagatggattagacgacttgttttaatcggcattggcttggggattatgcagcagatcgtcggtatcaacgtcatgatgtattatggcaccacgatcttacagacaactggatttggccaaaatgccgctttgattgccaatattttaaacggtgtaacttcagtggtcgcaacgattgtgacgatgcatctcatgggtaagtacaaacgccggccaatgttgctgactgggattatggggaccttattctcgttgatcggcatcacgttgacgagtcattttctcgctggcagtccaatgctaccgtacttcacgatattattgaccgtcatctatctggctttcttccaaggagcattgggtccgctcacctggttactgctttccgaaatttatccagcacgtattcgtggcttaggtatgggttttgccgccttcttcttgtggatcggtaatttctttgttggatatttcttcccagttatgttggcaagtataggcatgtcgaacacgttccttgtatttgtcggagccaatattatttcactgatttttgcttggaagtttgcatcggaaacagcaggcagaacattggaggaaatcgaattggacaacaagtttgacgataagttccctgaaaagagcaagattaataagaattaagtttcctaagtcaatttatttgaaaatgtaagcgcttcataccattcttgaattggacaggagcgtgtgtaaacgggtgatggagccagcgtgaggactttggacgcaatgaccaaagggcggtcatcatgtctgaggccacttacactccggttcctaaccgcaccggctcacgctcataacgcgttcgccagcgcagaagtctgcgtgtaaggacctcagccgcaatggccaaagggcggccatcacgtttgaggccacttacactccgacttctaagcgcgctggctcacgctcactatacgaaaggggtttgttttcatgacaacgcaacaagcagttaagaccttgaagaattttattaatggtcaatgggttgatgctaagaccgatacttttgaagatgtttataatccggcgacgggtgaggttttggcacgggtgccgcattcgactagcgaggatgtggcagatgcagttgcagcggccaaagcagcgtttgaaacgtggaaacgggtgtcgattcctaaacgtgccaagattcttttcaaatatcaacaactgctggtggagcatcaagaagagttgggacgtattgtcacgcaggaaaatggtaagagtctcagtgaagcgattgccgaagttggccgcgggattgaaaatgttgagttcgcggcaggcgtgccgactctgatgatgggggattcgctctcggcggttgcgactgatgttgaggccacgaattatcgttatcccatcggtgttgttggcgggattaccccgtttaattttccaatgatggttccgtgttggatgttcccgatggcggttgcaacaggtaatacgtttgtgttgaaaccgtcagaaaagacaccgcttaccagccagcgtctggttgagttattccaagaagctggtctgcccgatggcgttttgaacatcgtcaacggggcggttgatgtcgtcaacggtctgttggatcatcccgatgtcaaggcaattagtttcgtgggatccgaacgagttggcgaatatgtctataagcgcggcagtgatcatttgaagcgcgtccaggcattaactggcgctaagaatcacacgatcgttttagccgatgctgatctcgatgctgcagttaaaggcattatcagttcgtcatttggatccgccggcgaacgctgcatggcgacgtcggttttggtgctggaagaaagtattgctgacaagtttatggcgaaatttacgcaggcagctaaagacatcaaaatcggtaatggtctggataaagatgttttccttggaccagtgattcgtcaggagaatcaggaacggacgttgaactatatcaagaccggggttaaggaaggcgccaagctggtcttagacgggtcagcagaagccgagaagcgtgatggttatttcgttgggccaactatttttgaagatgtcaaaaccgacatgaccatttggcacgatgagatgtttgccccggtactgtccgtgatgcgtgcaaaagatttaccggaagcggttgccattgccaatcagtccgaactagccaatggcgcttgcctgtttacggattcggccgcatctattcgctacttcagagaaaatattgatgcgggcatgctgggtattaacttgggcgttccggcaccgattgctgtcttcccattttctggctggaaacattcattctttggcaccttacacgctaacggcaaggatagtgtggacttctacacgcataagaaggttgtgacggcaagatatgaccagcatcgttttaattagaaattccagatgtttgacgaggaggcattaacgatgagcttgttgtatccaaagcaaaatcaggaaatacagccgggcgttcatttgattcaagacgtcaatgcaacgaattctcccatgaaatacaccgcagtgaaagtcttggagcttgatgcgcaacgttcatttgccgagactttaggtaacttcgaggccggtattgttattctggcgggtaaagtgaccgtcactgccggtgatcagcgttttgaaggtatcggtcaacggcaatcagtctttgacaaaattccgacagacagtgtttatgttggaacgggcttatcctttaagcttgccgcacaaactaccgcgaaggttctgattgcatactcgccgaccacgacttcatttccggttcggttgattaagggcgatattcatcaaatcgaacatcgcggcaggtatcaaaataagcgtctggttcaaaacatcttgccggatgatctcccatttgcggataagttattgctggtcgaggtttacacggactccggaaactggtccagttacccgccacatcgacatgatcacgataatttaccgacagaatcgctgttggaagaaatctattatcacgaaatgcagccgaagcaaggatttgtttttcagcgggtgtataccgatgacttatcgcttaacgagacgatggcagtgcaaaaccaagacgttgtgattgttcctaaaggctatcatcctgttggtgtgccggatgggtatgacagttattacctcaacattatggcgggaccgatacgagtttggcattttcacaatgcgccagaacatgcctggattattgatcgaaagtaatgaaaaaggatagctttgcagctaagttgacgagggggaacatttcaaatgtcacaaaaattcgatttgattgctattggtcgagcagcagttgatttaaatgcggttgaatataatcgacctttagaagaaactaagagctttgcaaaattcgttggcggatcgccggcaaatattgcaatcgggtcagccaaattaggccaaaaagtaggattcatcgggaaggtgtctgatgatcagctgggtcattatgtgacgcaatacatggcagacgttggcattgacacaacgcaaatggtcaaggatgatgcgggccacaaaattggcttaacgtttactgaaatcattagtcctgaagaaagcgatattttgatgtatcgaaatgaagccgccgatttatatctgacaacggctgatgtttcagaagaatatttagcgcaagccaagatgttggtgatttccgggaccggattagcccaaagcccgtcgcgagaggcgattttaaaggcactcacagttgcaaagtcacttggggttgaagtggtgtttgaactggattatcgcccgtatacctggaaaaatgccgaggaaacgagtctttattatcaattagttgcccagcgtgcagatgtgattattggcacgcgtgacgaatttgatgttctggaaaatcatcacggtaacacgaacgagcagacaattgcgacacttttcaaatatgatcctaagctaattgtcatcaaaagcggggttcaagggtcaaatgcgtatacaaaagccggcgatcattatcattttggagttttcaagacgaaggttcttaagagtttcggcgctggcgattcatttgctgccgggttcctatatgcttacagccacgacttgggaatagaaactgccttgaagtatggcagtgctgcagcgtctattgtgattagtcaattaagttcttcagaagcgatgccggatttggcgaaactcacggcatttattcacgaagcagagaggcaggaggtgcattaggatgagcgcaatggagttgaagtcgcaaggacgagaagcagagtcagccgcggcagatacagttcgattgacaaccgcgcaggccctcgtgcgctttttaaaccaacaatatcttgatgttgatggtgaggtcaccccgtttgtcgaagggatctttgcaatttttggccatggcaatgtactgggtttgggggaagccttgcaggaagacccggggcacttaaaggtttatcaagggcataacgaacaaggaatggccagcactgcgattgcctatagccgtcagttgtatcgccataagatttttgcggtgactgcttcggcaggtccgggttcggctaactttgtcacggcggcgggaaatgcatacgtgaacaacattccgattctctttttgcccgcggatacatttgccacacgtcaaccggatccggttttgcagcaaattgaagtggatagcagcgcaactactaccacgaacgatgcgttgaagccggtgtcgcggtactgggatcgcatcgaacggcctgagcagctgatgagcgcacttttaaaagcctttgaagtactgacaaatcctgaaacagcgggtccggtcacgattgcgttgccacaagataccgagggtgaagcttatgattatccgcgtagtttctttaataagcgcgtgcatgtgatcaagcggattcaaccgagcgcggcggaagtaacggaagcggttcaactcattaaggccagtcgctatcctgtcttaattgtgggtggtggcgccaagttcagtgaagccggttcggcaattgaagctttctcggataagctaaatattccgattgttgaaacaccaactggcaagtccactatttcggcaacgtttgccaataatatgggcggtaccgggattctaggaacagcagcggctaatgaagtggtcgcaaaagcggatctcattattggtgctggaactcgctatacagactttacaacagcttccaagacggctattcatccggagaaaacccgcgtgcttaacattaatttgaatcgcatgcagtcgtataagtttgacggctttccgattgtggcagatgtccgggatacactgacccaactgactagtgaattgtccggatatcaaagtgactttaccaacctcgcagacctcaaagctgcttggcaacaggaacggcagcgtttggcccatacaaactatgatgcgccagattatacgcctgaggttaagggtcaattcagtgcggcaacattagctgagtatgccgagaagttacaaacccatttcactcagacggaagcggttattgctgtgaatgacacgattgcgccggatagcattattgttgctgcagcgggatcgttgccaggggatgttcaacgaatctgggatccagttgtacccaatacctatcacatggaatatgggtattccatgatgggttacgaggttccggcagcattggggattaagttggcacaaccggataaagaaagttatgccttggttggtgacggcagcttcatcatgttgcattcagaacttgtcaccgcgctgcaatatcataagaagatcaacattttagtctttgataattccggatttgcttccatcaataacttacaaatggctcaaggcagcaacagctatcgaaccgaatttagaactgccgaccatgatattttaacaatcgattttgccaaaattgcggaaggatatggggctaaaacttatcacgtcaatgatcgtgacagtttagtcgctgccttggaggatgccaagaagcaaacagtttcgacattaattgatattaaagtgctgcctaaaacgatgacacaaggatacggccaaagttggtggcgagtgggggtttccgaggtatccgacaatccaaacgtccaaaaagcgtatcaagacattcagacaggtattgatcaggcatttaaatactgaggaaaacaacaatacaaaggagcgattgacatggttgtcaaagttggggttatcggtacgggcgcaatgggacgtgcacacattgatcggctaaccaatgttttaaccggagctgaagtcattgccgtcacggatattgatcaagaagctgcccaagccgctgttcgggactttaagcttaacgcaaaggtttatccggatgacacgagtttgttaaaggatccggacattgatgccgtttttgttgttagttttggcggtgcacatgaggcgactattctcaaagccttagacaccgataaattcattttcaccgaaaaaccgttggcaacgacccttgagggagctaaacggatcgtggataaggaaataggcaaaccgcgaaaagtcattcaagtaggctttatgcgccggtatgatgagggtatccatgccttgaagactaagctggattcgggcatcatcggaacgccgttggttgtgcgcgccagtcatattaatcctaatgttgcggccaattattccaatgaaatggccattacggatacattgattcatgaaatcgatgaaatgcattggttacttgatgatgattatgcatcgattcaaatcacctatccgcgccagtcaagtcaggtgaccaatgaagggttgcgggatccgcaattagccacattgaccaccaaaaaaggaacggtcattcaagtgttggttcatgtgacggcgcagtacggttatgaagtcaaactcgaagttgtcggcgaaaccggagaattaaagctaccggattacggattcgagccaatcgttcgcacccaagcaactcagcaaaccgctatggaaacaagttgggtaaaccgcttcttgcaagcgtacaacaccgaagttcaggaatttatcgatcacgtggctaaggatcagtcaccggtcggcccgagtgcttgggatgggtatgttgcagcggtgacggccgaggccgcgattcgttcgcaaaaggatcaagaaccggttttgatcaatgttgccgagacgccaacattttatcaaacgaatcaaccggtaaaggcttagccatctagtcaagcaatgtaaaaaagagggggaaaacgcgatggttcaaagggaagttaaaattggcattgtggggttaggacgacttggtaaaatccatgcaaccaatctagccacgaagattccacatgctaagttgcaagcggcaacgagtgtggtaccggaggagttagcctgggcacgtcaagaactcggagttgaagaaacctatgaagactttgatgacatggttcaacatgccgatattgacgctgtctttatcgtgtcaccgtctgggtttcatttgccgcaaatagaaagtgccatgcaagcaggcaagcatgttttcagtgaaaagccgattgggttagatctggatgccattaaacacactcaggcagtgattgccgatcacccggagttaaaattccaacttggatttatgcggcgctttgatgattcatatgtttatgccaagcaattagttgatgcaggcaaaattggtgatatcacgcttattcgcagttacagtattgaccctgcagccgggatggaaagttttgtcaagttcgcaacttcagccaatagcggtggcttgttcctggatatgtcgattcatgatattgacgttattcgctggttgaccggtaaggaaattgataaagtctgggctatcggcttaaatcgcgcctatccggttttggatcaggcaggcgagcttgagacaggtgctgcactgatgcaacttgaggataagacgatggcgatcttagtagccggacgcaacgctgctcatggctatcatgtcgaaacggagattatcggaaccaagggcatgctgcgggttgcgcaagtgcctgagaagaatctggtgacggtcatgaatgaagaaggcatcattcggccaacctcacaaaacttcccagagcgttttgcccaggcattcttaagtgaagaacaggcttttgtcgacagtattttgactggtgagacagtcggcattacggcggaagatggccttcaagggaccaaagccgcgctggcactgcaacgcgcgtacgaaaagaacgatattgtcaaggttaccgatgttgataaaaaggtaggtgcttaaagtgacgattgcattaggaattgccccgattggctggacgaatgatgacatgcccgacttgggcaaagaagtgacgttcgaacaggccattgatgagatggcgctggcagggtatcaaggaacggaagtcgggaataaatatcctaaagatccagtggttttaaagcattacttggatctgcgacatctgaaaattgctagtgcctggtttagcgcctttttaacgaccaagccctatgaagaaaccgaagcagcgtttatcaagcatcgtgattttctacacgccatgggggccaaggtaatcgtggtagcagaacaaggccatagtgttcaaggcatgttggataagtcggtctttgatgataaaccgcattttaccgatgaagagtggcaacgcttggccactggtttggaacggttgggggatcgcgcccatgaagtcgggatgcagattgtttaccatcatcatatgggtaccggggttcaaacaacggcagaaattgataaattaatggccatgacagatccggataaagtgtctcttttgtttgataccggacatttggtgttatccggtgaggacccattaacaatttttgatcgctactatgatcggattaagcatattcacttcaaggatgttcgtcctgaacaagcccagcaagaacgtactgaccacttaagcttccttcaaggcgttaaaaatggcatgtttaccgtgcctggcgatggcatgattgacttcaagccgatttgggaagccattcaaaagcaacactatgacggctggattgtggttgaagctgaacaagatccagcaaaagcaaatccatttgaatatgcgctaaaggctaagcattatctagatacgatcatgacgattccccaagcagtttaagggttctgtttgagaagggatatggttttatggcgttgataccggcaacaaaactgattcaagctgcactggcagatcacgcagcaatcggtcactttaatattaatggtgccgattggttggaaacgtatcttaaagttgcgcagaaaaccggaacgccgattattgttgctacctctgatcgaattattgattttcttggcggattcgatttcattgccggctatgtacgctttatggtgcaggcattgcacatcaccgcaccggtcgtattgcatctggaccacggcttgtcagttgaacatgtttatcaggctattgatgcgggatatacctctgttatgtttgatggctctaagctgcccattgaagaaaacgtggctttaaccgacgaagtagttcgttatgcgcaccagcatcatgtttcggttgaagcagaagtcggcagtgtcggtggcaatgaaaatggcttaatcaatggcatccgttatgctagtgtcaccgatgccgttaaaatggccgcaaccgggatcgatgccctagctgcagcattgggatcggttcatggcgattatgtgggccgtccgaatctgaactttgaacggatggctgctattgccgccgctaccaagttaccactcgttttgcatggtgcatctggcattcctgatgatcagattcaacaggcgatccaaaccggaacggctaagatcaatatcaatacagaagtgaacacggtgtggactgcagctatcacaaaagcggtgcaagccaaacgttccggtcatgatccgcaaccgattcttttggcaggcaaaaaggcgattgcgcaattagttgaaaccaaaatgaaggcatttcatattcttggaaagagtaaacgctcagtgacctttgaataattgtccggtcacatggcgattgaattggctcatgtcggtcatagtctaataagaatactgattgtcagttaccgctgcgtatgaggagggggaacgatgccattagttcgatttgacatgttaaaagggcggtcacccgagactattaaagctattttgcaaatcacccatgaagtgatggttgcagcgtttgaggtacccgagcgtgatcgttatcaaattgtccaccaacatgagccatatgaaatggtggttgaggataccgggttgggcataccacgaacggatcaggtggttgtgatttcgttagtgagtcgcgttcgtacggttcaccaattagagcagttttatgaaagtttggcaaggcgcttatccgaagcgggattagtggataagaacgatctcatggtcaatgtttcgtttaatcatgatcaaggctggagttttggtcaaggcaaagcccaatttttggatggcagtttataaagagaatatcaagtaaagcaggatgccttggccgcttctggaactttgccagaggaatcgaccaaggtatttttgtgaacgcgagtcggtgtggtcagaaacgggagcatagaggcgtttggtcatggtgctcaaagttcgtatatgtgcaggttgctgcaccgaggcgtctgtatcggtggcgggcaactgctttagttgacgccataattgcgatcacactaagtcgcagattgtttgggtaggcgaagagaagtgggggagtcgtgatggggatagaactgacacaaatggctttgaatcgaaaaattgctcagaagcggccactggaaaacttttttcaattagccgaagctgctggcattcatcaagtcgagttacgcaatgatatgaccacttctgatggctcagagactgtcattgatggcatgcaggttgcagaatttcagacgttaaagcaaaaatacgacctgcagattttaacgattaatgcgattcagcaattcaataatccagccaaattaaacaaaaatcgcgatcttttgaccaaactggcggaattgtcggcgcaaattggcaatcaggcgattatctttgtaccggaagttaacgcacaggacaagcgaaccgagcaacagcgacttgatgatgccgttagcagtttacaggtgtttggggacattctgtctgcttatcatttgacgggattcattgaaccgttgggctttagggccagcacaatgcggtatccgtggacagcgctggacgccattaatttatctggccggaccgagtttaagctgacgattgatacgtttcatttcttcttggcacatctaacagccgaacaattcaaagcaggtgttgatattaaccgcgttggattaattcatctgtcgggaattgagccgatccacgcattgcgagaagttgtggatgaagatcggattctgattaccgagcgggatatcatgcaaaacattgagcaggttcatttgtttgaggcaatgggttatcggggccattattcatttgagccattttcaagccggttggcagccgaaaccaaccagcaacttactcagcagatattagcaagtattgaacggttgaatcagccaactgcagtgtttagtacggaggtgacgcaaccatgaagttagcctatgatccttctatgttccgcgactcaatgaccttgaagcaaatgtttgatgaggttgcgcggttagggtatgagtatgttgaattgtcgccacgccgcgattttatttggttctatgagcacccagtagctgatcacacgctaattaagcaagtaaaaaagtacgctaaggatgccggcgtaaaaatttcgtcgatactgccggtacagcaatggtcttctcctgatgaacaggagcgcgagtttgcggttcgcaatttgaaacgtacgattgaaattaccgcagagcttgaggtgccggttttgaatactgaatttgctggcgataagtttcagccgcttgtttctcagggacagtggtataagtctatggcagaattagcgccggtgtttgaaaaaaataatatcgagctggaaattcaaccgcatcccaatgacttcatcgaatctaatcttgctgccacacgcttgattcgttcgttggatttggattgggtgcatcaggtttggtgtagcgcgcacgcattttatatggacgacgggcgtggagatattcgtcagcagtttgctgagtcgggggagcggattacccatgttttaatcgcggatacatttaaccacaaaggtaattttggcttgcggtatatcatcaatccgcctggggctccggtaacgattcaccaacacttgaacccaggggaaggagaagtcgattttacaacgctttatcaggtgttgaatgagcgccattttgacgggatcatcaccaacaatgtgtttgcgtggcctgatcgcgttgattggtcaaatgacgtcaccttacaatcaattcagtctggtttgcatttgttgaaaacgtgacaagccagttgcggtaattgaatcagatttagcttttttctgaaaaacggcacctcgaaaaagaaatccgagctgccgtttttgtatacttggaatggcgtctttgggtaatacgatgtgtcctattgttactgccgggttgcgtcaatagtggatctgacgcgacggaaaagcggtgcagtttgactgttggtttgaatcgcgctgatcatgaacaaagtgtccataagactgagctcagcgatcaaggcgtgaagggcttcggtgcgatagcgggattcttcagccacggcaacaaaggcagcatcggccattttggctaagtgtgagccgggagcgccggtgatgacgattaagggtacgttttgcttttttgccagttcggccaaagcaattgcatctttgtctttgccggagtgggaagtcaaaatcatcgcatcggcaacagtaagatgtgttgcagccatcagttgcatatggtaatccgccgcgtaaacgaccggaatagcggttcgtaaaaacttgtgataaccatccaaggccacgagattgctggcgcccaatccaaaaaggcctaactgatttgcatgggtgatccagtcgaccgctttggttaaagcagccgagtctaaatttgtcagcgtggtacgtaatgcatctatattggaggtgaagatcttatgagccagcgtttcgaccgaatcagcgggactaagctcagcaaacagcgtgtgatctggttcaggtgttgattggaccagtgccattttcaaggcttgaaaacttggataccctagggccttggcaaaacgcgaaattgtggccgtactgacaccggtgatggcgcttagttccgcaatattcgcgtggctcgcacgatcagggtgctgctgcaaataatcagccagttttttttcttggcgacttagattcggtttataaatctgcaattggaccagaaagtcgtgcatgttgccccctccatttcaagattattatagcatcattcgtttgaattgaaaattatttacgaacaaattgcttgatttttgtaattattttacatacaatggcaccgtaatcaagaaagatggcttccaggaagaatgattcgttgttgctatctaagatgaatcggcggtgtcttgaagatgcacagaagttaaataatggtagattcattggtgcagaaattgattgatgctcgcgtggtagccacgccggctcacgcgcacgcacaggaggttgcaaacatgcaagtaggtatggttggtttaggcaaaatgggaatgaatctggttgcaaatatgcgcgatcatgatattgaggttgtggcgtttgatttgaatgatcaggcgcgcacggaagttggtaagtatcaggttaaggcggttgcaagtctggatgccttggtaatgagcttggcctcaccgcggattatttggagtatggtaccagctggcaaaccaaccgcggcaacgattcagcagctggctaagctactgagtcccggcgatgtggtcattgatggcgggaattcttattatcaggattcaattgcgcatggtaagttgttagcggcggaaggcattcactttttcgatgtcggcacttcaggcggcatggctggagcccgcgcaaatggtaacttcatgatcggtggtgatgaagaacagtttgctcagatcgagccgctttttaaagccatcgcagctccaggcgggtatctctacaccggtccggttggctcaggtcattatttgaaaatggtacataacgggattgaatatggaatgatgcaggcaatcggcgaaggctttgatgtcttagcccacagtccctatgcctatgacaatgcggcggttgccaaaatgtggaatcatggttccgtgattcgcagctggttgatggaactggccggtgacgcctttagtgaagatgctgacttggcgaaaattcaagggattatgcatagttccggtgaaggtgcctggacagttgaagaagcgttacgtttgcacgttgccacgccggttattgccagcgcgctcatgatgcgttatcgatcggaagaggccgatacaatgaccggtaaagtcgtagccgcattgcgtaatcaatttggtgggcatgcagttgatctcacaactcaacgtcactgagccgatctatgcgttatggtgctggatgagagcaacgttttggagaatggacggctacgatcattgccgctgaaacttcatgtcgcgaaaacggatcaggtaaaagttgttcgaagtgatttcagcatgtgacgctggcggatacagattgaaaaaggagaagatgatgatgacggtcaaatacatgatcggggttgatttaggcaccaccagcactaaagttgttttatttgatctaaaaggcaacgccattgcgactgctaataacccatatccgttgtatcaggatacgccggacatggcggaggaagacccagaagaaatttttgccgcaacggttggtggtttaaccgaggtcatgcatcgtggcaatgttcaacctggcgaactaggtggtgtctcattttctgcggccatgcatagtttaatcttgatggatgaacatgataagccgatgacgcgggtcattacctgggcggataatcgggctgcggcgtatgcgaccaaactgaaacaaagtgatttagggatgacgttgtttaaggctaccggcgtaccgactcacccgatgtcgccgttggttaagttattgtggttgaatgatgcgcatccggagttaatggcgcgggcgacccattttattggcattaaagattatattttattccgtttctttggccgctatgttcaggattactcgcttgctaatgcgactgggctgtttaatattcacacgatggactgggacgatcaggcgttgagtgttgccaaagttcgccgcgatcagttgcctgagcttgtggataccagctatcaactaaccggtttgaatgccaattatgctgcggtgaccggtattgacgatcagacgccgtttattctcggcgcgagtgatggtaccttgagcaatctgggtgtaggggccattgatccaggtgtccttgcagtgacgattgggacctcaggcgcagtgcgggttgtgacggacaaacctgttgtcgatccacaagggcgtttgttcacgtattacctcgcgcctaatcagtgggtcgttgggggtcccgttaataatggtgggattgtatttcgatgggttcgcgatcaactttttgctccggaaaagttgaccgccgaacaattgaaggttgattcttatgagatcttgacggaaatcgcgagcaagattcctgccggggcagatggcttattattccacccgtaccttggcggcgaacgtgcaccgatttgggatgcaaacgcccgcgggagcttcttcggcttaacccgtcagcatacgcgcgcacacatggttcgggcagcactggaaggcattgtttataacctgtatatggtcatgctcatgattgaaggtatcaccggaaaaccccgggcaattcaggcaactggcgggtttgcccgcagcgcgttgtggcgccaaatgcttgccgatgtctttgagcaggaagtcaatattccggaaagtttcgaaagctcagcgctaggggcggtcgtcatcgggatgatgtcattgggtttgattgatgatcttagtgcggttaaggatatgatcggggtgacgaatacccatgaacctaacgaagcgaatttcgcggcttatcgagcgttattgccaatttggattcgtttgacacgcaaattgggtagtgaatatcaagccattgcggattatcagcgggcgcatcctgatccggcggcacgcaatcaggcgcaggattaggctttaagtttaaagagtggacagtttgtgtttatgtcttgcaattattaggtgaccggttttaaagcactaactgatgaacggttaggtcgacagacgcattttgagtttagacgcggctgccgttttttataaacgatattgtaagcggtttctgttgccgggatgcgagattttggttggctcgcgctcataacgcgctccccggcgcaaaagtctgcgtgtaaggacctcaggcacaatggccaaagcccggccatcacgcctgaggccacttacactccgacttctaaccgcgccggcttgcgcttactaaatcctgaggaggaaattaaatggacttacttgtcttgatactaggtattttgttgttattggtactcatcatcaaatttaagtttaatacgtatgtttccctgattattactgcagttgttgtcgcgcttggtttggggatggcgccggctaagattgctacgagtatacaaacaggcattgggtcacagcttggcgagttggcacttgtctttgggtttggggcaatgcttggtcggttggtggctgatgctgggggtgcgtatcggattgcccataccctgattaacgcatttggtcggcggggtttacagctggctgttgttttggcgtcattcattatcgggatcgcgttattctttgaagtggggattgtcttgttggtgccgatcgtgtttgcgattgcggctgaagcaggggtcccgattctgacacttggcattccgatggcggcggcgttatcggttacccacggattcttgccgccacacccagcgccaacagcaatttccacagcactaggagcgtctgctggtttggtgctggcatatggggttatcgtagcgattccgactgtttacattgctggtccattattttcaaaacttgcgcatcggtttgttcctgatgcgtttgagcggcgcggtaatttaaaagcactaggcccgcaaaagacctttaaactggaagaaaccccaggctttgggatctcagttttgacctcgttgtttccagtcattttaatggcaattgcaacgatttatgaattggtgatttacggtggcaaaatgccaaagaccccgtcaggcatggataatgtaattgcttttattgggtcaccaagcattgccatgttgatttcgcttctgtttgcgatgtgggcaatgggttatgcacgtcagttaccggctaaggacatcatgaccacacttgaagaggcagtgaagtcgattgcgatgttgctactggtcattggtggtggcggtgccttcaaacaggttctgatagatggtggcgttggtgattccgtgaaaaatcttttcgtcgggtcatcaatttcaccattaatactcggatggctaattgcggttgtacttcggattgcccttggctcggcaaccgtagctgcaatgaccgcttccggactagtgctgccgctgatgcaaagcgcaggcattcaaccggcattaatggtgttagcaatcggtgccggttcgttagctgccagtcacgtgaatgatgccggattctggatgttccgtgaatattttgatctgactatcaagcaaacattgttgacatggacattgctggaaacgattatctccgtagtcggtctcggcggggtgttgttgttaagcttggttgtctaagcaactggtggaaaacgccaatatttaacactgacagagtcgctctaacgcctaaagttggagcggctttttggatcaccgcaccagttgttgctgttgacaatgctaaaaaatctgtgaataaaaattaacttaatttggtttacatcagtcaacaatactttagttctcatttacgtcattcaatcgaaataatgaaaattcataaaaaggttttaaaattcaaatgattcgtctagtacgtgcgggctcgaccaacaaaaatgttaaatttacgtgtaaatcgtgataacataaatgcgcgtgtgctagtttatcgaggataagagtcatggtagtgatgcggtcaaattaggggacgcaaaggcaaaggttgaaacggagggttgtgattgctaaacttggtgaagctagtttagctgtcataatatagaagcgatcggagttaaaatgaaaaccaaagaaattagcaaatttgagcgttattttctgtacatattgttttttgaactgtttgctggcggtggtggccgacttattgcaatcgggccgttgtcgattcggcagattttgtttgttggcgtgatggcagtattccttgtgcgctttattttgaacgctgatactagaaacgagatctggggatattttaggcatccgaatacagcggttttctggttatcacttatcatgttgttttgggtcggtatttcaagtgctattggagtcatgcacgggcatggtgtgggattggttgcgactgacttcttccggacgatctacgttattatgatcctgccgtttatttactacattggtaaggatcggttttcacttaaagatctcatgcgttgtttgtttgcagccgctgcgttagtttctattgttacggttcttatcagccttatcggtaagtttgcaagtgacatgagctttcatcacttttatgattggattaatggtgtgatgccaggagatttattcttccgaccttcaaggggcgtgttttataagtcagactttttagtcatgtttgttgtgattatttcgctaattaaactcgcggaaaagaaaatctcctggattgagggaggcgttctggttgttggatcgctttccattatattgtcagaaagtcgaggcctttatttaggcatcttaaccggcattggtacttatgttgccgttaaggtagttgtttatttctggggtgatcgtcattctttaaatttgaacaaaaaaatgaatttccggcgagttgcggtgatactgcttacggttgttttgtgcggctttttttacagtaatgccaccattgctcgttttagcaagccaactaatgcagatttgcgcgaggagcgtaaatttaagtggcgtgatgccaatgggggagggaacgacacgagtttgcgctcgcggtttgttcttcttactgatgccacgaagattattgaaaaaggttcgattgtcaacaaggtggctggaaatggttatggaacagtcattggcgatcgtaaggatggcatcgaaatgagctttgttgatatcttggtggaacaaggcgttattgggcttgccatctggttggcgttctcattacttccgctatattatttcttcaggagtttcttgctaagtcggcaattagcggatatttatattggccttttgggaagttcactctcaatgattgttgtgacaaacattaacccatttttgaatagtccaattggattagggttcttgttacctgttattgtgattgcgtataaatcgttcatcgctaccaaagatagtcaattgacaattaggcaggcttaagaagataagaactgcaattttagactgaaaagttggaggcaaacgatgaatcgagacggccacagtttcttaatcgtattgtatcgccagaagctaagcaaaagtaagacctttcaaacactgaattcgcaattaatggagaatgatcacttaattatttatgataattctccggagtcgatgttagatgtgaagccggccaatttaacctatttccatgatgaaggcaataccgggcttgcagctgcgtataattttgcggtgcaacaagcacgaaaacgtggcgatcagtggctaacgattttcgatcaagatacaacacttcctgccgatttcaaccaaatagtcaaaacgtctatgcgccaaaccgcaagcgctgttgtcttggctcccgaagtcgtgctggctgatggaaaacagatttcgccattttggatcgaagacgcattgttttttcatttccccgctgcggtttccaaaacgcgtgctgcaattaattcgggcatgtcgcttaacttggcggcgttcgaagggacagcaccaatttttgatcgccgatatcctctggactttctagattacgttttctttaaacagttacaaaaggccgggaaagagcttaaagaaattccggttcgattgactcaagaactttcgctaaacgattttcgcacgatgagccaagttcgatttgaaaattttcagcgaacggaagcaaggtttgtggctgaattttatccgcgctttatcccacaatatcgcaggcgcctatgctttaggctgattaagcagttattgaagcgcgcccagtggtcgaaactgaaggtgattatccaggtgataggaggaggaatagctccatcatgatttctgtttgtatggcaacttataatggtgctgccttcattgatgcgcagctcgaatcaatcttgatgcagctcgatgcggaagatgaggtcattgttgttgatgatgggtcgacggatgaaacaatcgcgcgaattaaccaacacaatgattcccgaatctccttgattgaaaatgcgactaatcggggtccagtgggtagtttcatggttgcgatgacccatgctaaaggtgattatttatttttagctgatcaagatgatgtctggcatttggataaggttaaaaaggtgcgcgcggcctttgaggatcaagatgcaatggtggttgtccatgatgcgattgtgaccaatcaaaagcttgaaacgattgactcatcgtggaatcactacaatcatagcgaacccaatcagtcgctgctgagaaccttgcttaaaaatggttatacaggagcaatgatggcatttcggcgcgaattgttagcactaattttaccttttccggcaaagttgccgatgcatgattggtggattgcgttgattgccttaaaacatcgggaaaaaattgttattttgcctgaccgacttatggattatcggcgacataccggtagcgtcacgggtaaacggcgaaatctgggtgctgttattaccgatcgcgtgcgcatgctgcaaatgttgcatggacgttaatgaagagttaacgcgactatcgaagtgaggaaggcaaatggacactaaaacaagaattgcggttttgatctcaacttataacggacaagcatttgtcgaagaacaggtacaaagcattttgtctcaggcgattgatccgttgaaaattgagcttcatgtctatatacgagatgacggttcatctgatcgtacccgggacatactcgctaaacttgcagacgcacatccagacatcatcagaattcagaccaaagcaccaggcaacattggcgtcaaaagatcctttttcgttttagttcaagacccggaaattgatgctgattatttttttctagctgatcaagatgacatttgggaaccggataaaataaccaagaccctggcggcgtttcaaccggaaaaatcttcgctaccactgggtgtttattcagatctttggcttgctgacgcgaatgggcattcaaccggtaaaagtatgagtgagcaggcacggtggcccaagaatctggcagtagattatcagtatctatcatttgattatcgggtcactggggcggcttttgcgtttaaccgaactgcaaaaaaactttttacacaaattcccaacgcttttattccgctggtaaatatgcatgactcgtttatggctctgatcctttctgtctgtggtaaacttatccaaattgacgaaccgcttgtcttatatcggcagcatggcgacaatctaatcggtgggttaaaaaagaagcggagccttattgagacacttaacaacaagaagcgcgaagaaggtcagcttattgttgacaacctattacttgatgcgtttcttaaaaagcaacatcttactattcgacaagatcagcgggctataatagatttgtatgttgattattttaataacgtacaccatgcatttaaacgggttgcaacgagtgttaagatttaccacatcatgcatcatccaagaaaaagagtttcatttatattgatcgctttttttgatgttattgacatgattgcaccatatgatgaaataaaagctgctttggcatgagttatcagaaacctttaattgtgtgcggttttagaaaattcttaagatgctctttaactggagcatctttttagcatgttgctagccattcaggcaacgggttattagcgtgtcagcagtttggatgacgcgaacttgctaagtttgctgtcggggttggttgaaatctggtagaatcacatggtattggtaaaattgcggtgattggctctgaagtagtttctaagctgtctatcgctgttatgagtggagatttttatgaaggtcattaagaattttttttggaacgctggctatcaagtattcgcacttttggttccattggtgacggtgccatacattaaccgcgtgttaggccctactggtgtcggcatcaatgcttttacaaactcagtcgtccaatattttgtcctcctgggcagtttggggattaatctttatggtaatcgcggtactgcataccggcgcgatgacaaacaggcgatgacgacttatttttgggaagtcaccattttgcgcttcctagcgattggcctatcagtgggcgcataccttgtttttattatgatggttgataaataccgcgttttttacttggcacaaggtttgctgttgatcggagcggcgtttgatatttcttggtttttccaagggctggagaattttcgagtcacggttgtgcggaatgttctggtcaaaattggctcagttattttgatttttttattaatccacaaacctgaagatacgatgctttatattttaattctatctggctcgcagttgatcgggaacttaacattttggccgtacttgcgcaacagcttagcacactttccaaaactccggaccttgcatatttggcagcatgttcaaccggcatttttgttactagtgccccagttagcaattcaaatttatgtgcagctgaataaaacgatgctcggtattttgcaaggagttgcagcatcgggattttacgaaaactcagataaaattatcaaaatgctactggcgcttgtgactgctactggaacggttttactaccacacgttgcccattattttgcaaaaggcgatcatgatgcggtaaagcgttctttggaaagttcgatgcatgtgattctggtcatggcatttccgcttgcatttgggattgcagccgtttctaaatcatttaccttttatttctttagtgctaaatttatgccagttgcgccgttaatggcagtggaggcaatagttgtcattccgatagccattgccagtgccattgggatgcaatacttactgccgaccaatcagataaagtcatacacaacgtcggtcatcctgggatcaattgtgaacatcatcgttaatgtgccgctcattctttggttaggaacaatgggggcggttgttggcactattctttcagaaacggttgtaaccgggtatcagatttattccgtgcgtcatcagttatcactcggggggctgtttagtgagtcatggaaatatttacttagctctgtagttatgtttggtgtggtgtgggctcttgagcagctgtggtcgcgtagtttaataaacttagcgctcgaagtggttatcggaatagttgcctattttgtcactttattagtattacgaccacacattgtttttagctatgtcaagccataccttgatcaagttcgacatcgcttaggacattagcttgattcacgaaaagttgtgtcgtgcattggtcaacagaaaggaataaaatgtcgattcaaaaacaactcaatgcttttaaaggcaaacgcgtgcttctcctagcaccaaaattttttcactacattggtgagattcttgatgctatgaaagatgctggtattgattgcgattttcttgatgagcgcccgttacctggcttcacaggcaaagcgattgcgcgttatgtaccggtggttaatgaacgcaaggtacgagaaaacattagacagcggcttagcgagaatcattatgactacttattagtcataaaaggggaatcgctgagcaccaagcttttgtctgacttcaagcaagctaatccgggtgcaaaaacggtgcttttcctatgggattcggtggctaattccaagcatgccaaggcgtttttcccggacttcgacagtgtgtataccttcgatgccaatgatgcggcaaaatataaaatcgagttcttacctctgtttgtcggatcccagtttgatccgcgtctcacggcaactgatcagcagccgaatattgaccttgcttttattgggaccgtacattcgaatcgcagtgaattgttgaatgtgatcgaagagctggctcatgaagaggcgctttctttttatgactttcgctatgtccagagtaaattgatttatgcggtccgttatatgcaagattcggcgtttagaaagtccccagaaggcacgatacactttgacaagattgccgccagtgagatgcttaaagtattgcgacaaacgcggatcattgtggacgtgacgcatcccaagcagactggcttgactgggcgtgtaattgaaggcttgtcaatggggcggaaggtgctgacgaccaacagcaaggttttggactatagcttcattaaccaagaaaatgttcaaatctttgatgagcatttggcacaccttgataaagatttcattacatcgccgtatgttggcaatccgctgacggtttatcataacttttcggtgtataactggcttggaacggttttgtccggttcaccatacgcgccagttagcgattagtagatttatcaatcgcgagactttttatctaggagtaaactgcgagaaaagaatgatgaaccgataacgttcatagatacagaaacggagattataaaattatgtacgaaccaaccaaaaaacggcgcgttgccgaagatgttgccaagatttttcctgaagaagtgacaaatcagatttttgatgtgattgcggtgatgcgtaaggccaaacagattgtgacggcgccggttgcgattgctttttccgatgattataccgatgacgaaatgtatgcgatgattattcaaggcaatttggcaccggcgcaggagtttccgctcacttacaaaggcgacaagccattcttaggtcatggctatatcttagtggtcaaggacaagcctaaaacgatccgaattgacttcagtgcggccaatccattcaaaactgcggaaaaggactgatctgcgggtggccacagaggcgtgatttcacactcatggctgctcgtataccgatcatccacggataccggcttttgtgtgatctaaatagcactggtcttttcatgaaaacttcggtacaatagtaaatcgtaatcgttaccgtttgctattgggaggcagctatgagtgaaccaattttgaccgtggaccatcttcgtttcgggttccgggatcagcagctttatcaggatttgagttttcatttggatgttggctccatgacgagcttggtcgggccgaacggggtgggtaaaacgactttgattcgcctgttgatgggccagttgaagccgcaagccgggaccatccgttttcgtaagcaaccttcagttcgattgggatatgtgccgcagtttcgaaatgtggatgccgagtatccgctgtcgatccgtagttttattcagttgcgccagttggatcacctttttttctggcatactgccaaggaaaaggcggctttagctcgggtgattgaggcgacacatttaactcaaatcgcgaatacacggctgggcatggcgagtggtggcgaaaagcaaaaggcgtacttagctcaggcgctgttagatgagcctaattttctgattcttgatgaatcgactgctagcttagatgttaatacgaagcacgagttaatggacttggtacaagagcttaaccaaacccaaaaattaacggtcctgtttgtcacccatgatctcagtttagccaagcaatataccaaccagtatttattgctgacgggggacagttacgaaatgaagccgactgcggaaatgaatttggcttcaatgccggaagagttacgcaacgatgccgagaatcgcggggtgatcgcatgaatctatttgcctatgcttttatgcaaaatgcttttatggccagcacctttattgcgattacaacggggattgtcggggtctttgtggtggcgcgtaacatgtcctttttggcgcataccttgtctgaggttggttttgccggggcggcgtttgcggtgtttgccggcattaggccattggacgggatgctgctctttaccgcgattagcagtatcagcgttgggcgcatgtcggttcaagcctcacgtcgggaagcatcgatcagtgcggtttctagcttgtttatcggtttagggattctgtttttatcactttcgagtgcgaatgccagttatgccacaacgattttgttcggcagtattattggtatttcccagggtgacgtgtggcagctggttgcattagccgcgggggtgttgttcaccttgtattttggttatcggcggttggcgtttgattcgttcgattcggtcggttctgccgcacaggggttgaagagtaagtatatctcgatttatttcctacttattctggcagtttcggtatcaattggagcgcagattgtcgggagtttgctcgtgtttattcttttgacgctgccgccaaatgttgccaagtatctgggtaaaacgttgccgcagatgattgtcatctcggttgtgaccgcattgatcggtgtctggagcggcctttaccttggctttttgacaaactggccggttacgttcttcattgctgcgattgagtttggtttttactttttggcattgtggtatcaccaaaagacaaactaaaagctgcttgtttgttttcaaataaaaatggccctagagcgacgagaatctcgttgctctagggctattttgatatctgaggctgtaaagaaccattgttggcgccagtgggttatcgatgcggtttaagttgacgcaaaaaagtcgttacttctgcgcgataatcgtgcttttgctcgaattgtgccagataaggagcattatgggtgctagtggctccggtatgccgcagcttcgtatatacctctaagtaaggcaaggcagcttgtttggcttgggctaattcggccgctgcgtcatatggaacctgacgtaaatccagatccgtcattgccccatgatgaaggctcagcaaagcatagtctgcataagtcgtggtttgtaaatgtggccgcggtgaatacgcttgaccaattgagccgggattcagtatcacctgaccactgctggtgtagcgcagtaattgctgatgggtatgcccgtaaagggcaatgtcgattttggggtcaggcgcgatctggtcgaaattgctttgtggttgatccggataaagtcgatggccgtggttgctagtcggcaagttgtgggcgagactgatcgtcagaccgtcttgttcaaagatttcgtgtaatggccagtggcgaatggcggtcagtatatcggcatttagctgcggccataaataagcaacgagccgactaaagtagacatcggtgggctggtttaagtctaccgggccgtccaatacccagaataggtcatcatcccagttgcccttaaccagatgtgtcaacggcagtgcatgcagtcggtcccaaagcttagctgcccccggtcccggtaggaataagtcgccaaggaaccagtattcgtcagcgtgatgtgcctgtgcgtctttaagcactgctgaaaaggcggtcatattgccgtgaatatctgataaaatggcgatttttgtcatgcgttcctccagtgatcgttcattgtgactaagccttgcgttcccagatcgcctttaccggttgccaccatgttagcgtatagctgttcagccagttgggttgccggtaactgcagatgcatttttttggcttcgtctagggcaattcggagatccttgagaaaatgtttcgcaaaaaagccaggggtataatcgccctgcaacatgcgaggaccgtaattgcttaagctccagttggcgccggccccactgccgaccaccgtgagcatttcatttaaatcaagtccggccgctttgccataaaccagcatttcagtaagcccggtcatggttccggcaatcataatctgattggccatcttagcatgttggccagatccagctgggccaaaatagttaaccgacgttgcgatcggtgcaaataaatccttcaatcggggcaacagagatttttcgccgcctaccatgatcgtcaacgtgccgttcttagcgccaatgtcgcctcccgaaaccggcgcatcaatggcatgaacccctttgtctgcagctttggaagcaatgcttttggctagtgttggcgtactcgtggtcatgtcgatgattaaatcaccggcgtgggtgccagcaagaaccccgtcacagccataataaacggtttcaacgtcctgaggaaaaccgaccatggacatgacaacatgacactgtgccgccaccgcatgcggagattccgcccaagtggccccggcatctagcactgtttgcgcgtgggcttttgtgcggttgtaaacgatgacctcgtgaccggcattaagaaagtttttaacgatcccggtacccataacaccggtaccaataaatccgagtttcaaacgactcatcctttctgcaagattttttccaattccgtcaagcgctgttcaaatactgaaaaggcggcttcaagataatcgggtttggtcatatcaacgccagctgttttcatggtgtcaatggcatacttagaactccctgacttcaaatagtctaagtaatgggcagccgcgtcaggttcaccgctactgatgcccgctgctaaggttgaggcagcagcaaagccggttgcatactggtaaacatagtaattgtaatagaagtgcggaatgcgggcccattcaaaggcaatttccggatcgcgtgcaacttccggtccataataccgggcgttgagatcggcgtaatattgtgacatgctggtggccgtcaacggttcgccttgctgatcctgttggtgaatccagtgctcgaactcggcaaattgtgtctgacggaaaacagttcctttaaaaccatcgagatagtaattcaaaatgtaggctcgtactttgggatcatccgaatgtgtcaggaaataatcagttaacaggttttcgttggttgttgaagcaatttcggcaacaaagatcggataatcaccatagacatacggctgattgtgacgcgtgtaccaactgtggacgctgtggccggtttcgtgaaccaacgtatagagttcatcaacggcatcgtgccagttcaataagatgaacggattggtatcataagcaccaccggaataggcacctgaacgtttgcctttattttcgacaacatcaatatagcgattgtcaaaaatttcgcgaacatgctcaagataatcatcgcctagtggggctaaagcttttaaggcctctgctttggcttgttcaagcgtataagtcaacggcggctggccagtcagtggtgtgtaaatgtcatacatgtgtaactgatcgactgccaacacctttttacgcaaggcgacataacgatgtaaaagcggcaggtgggtgttaacctggtcgataagcgtcgtgtacacactttccggaatgtgattacttgccatagcggcagcacgcgcatttttgtaatgatgcgctgtcgcgttgaaattatgggctttcacttgaccacttaacgtttgcgcaaacgtattttttaaactttcgtaagcacgcagaagggcctcgaaagcctccttgcgtaatttacggttagtcgagcgaatcaactgaccgtacaaaccgttactaagctggacggtttcgccatcttcattttcaacaaacccgaattgcagatcagagttgtttaatacattgaaggtcgcgtgactggcatttaaggcatcgcccgcacttgcaatcaaggcctcggcagcggttgtcaagacgtgttctcgatttaccgtgatggcatcaataaaatgtccgaatggcttcaagctttcagtgtcacgccaggccgttaatttgtcgcttgggatcgccagaatttccggatccaaaaacgctaactgactggctaattcagcacccaggctttcagctttggcattcatcgcctgataagtggcgttaccggtatcttgatcgctttttaaacttgaatagacgtaaaccttctcgaagcgtcgaaaaactgcaagtacggctttaatgccggtaacaagggcgtctgccgagttgcctaacgttcctttcaatgcgacggccgctttggcttgggcacggacagctttaaagtcggtttcccaagctgaatcatctggataaatcgttgtcaggtcccaggtcaattgcgttgggacatcctctcgtgctggtaaatgttgcatctaatcagctccaatttctaatatttctttaatgttaccatatcaagccgatttttgagctaattcccttttttcttcataattatctgatacactaccgtggaaactaaaactggagtgaagcacatatgtccaagcaacaaaaatctgatctacgaatcaaaaatcgcaaacccaaacggcgccatccgattttacgtgcggtggttctcattgtgctcgtggccctttttctggcgggtggctatgcagccaggttctactcacaagcaaaaaaagcagttgcgaagacttatgacccggttagcacgaaaacagtcaattccgacctcaatggcaaaaagccaatcagtattcttttgatgggtaccgataccggtgcttttggccgcacggatacaggtcgttccgacacgttgatgcttgtgaccatcaaccctaaagaaaagaaaacaacgatgctcagtattccccgcgatacgttagcagaaatggtggggacaggcgatcaatcacctacctatgagaaaatcaatgcggcatactcatatggcaagtcagacgcggcgatcaaaaccgttgaaaaattattgaatgttccgatcaactattatgtgaccgtcaacatggaaggactacaaaagattgtcgatgctgtcggtggagtggacgttaatgtgccgtttacctggacggatgcaaatacaggcgggcaaacctttaaaaaaggtaaggcgcatcttaacggtgaactcgctcttgcctatgcccggatgcgtgatgaagatccagaaggcgattatggccggcaaaaacgtcagcaggaagtcatcaatcagattgttaaacacctgatgtcagttaaatcactgacgaactatcagaaggttatggactcgctgtcatctagcatgcgaaccaatcttacttttgatgacatgatggcaatcgcccaaaattatcgcagttcggcttcaacgattgagcgcaaacagctgcaaggcattggtgtttatattgataacgcggcttatcaggttatgaagactgatacgcttcaaaaagcatctgatgaaatgcgtgctcagctaggcttgtcaaagaagacattgaataatttcaatacccaccaaaacgaaattaacaattcgcttgggttcgattggactggcaataatccggtttatacggtttcacttgatggtgtgaccacaggaccttgaagcgtttgataaagttagtgtcaaaaagcatggccacttcggtatttgaaggcgaccatgcttttttgtgtcttatggaaatgatgatgaaggtggcatttaaaatggttactctggatcaggtaaatcaggtgccaattttgcgccgcttaatttagcagcagcaagaccacttaagaagccaatgataaggaacggtacaaagtccatgccaactgagaaccaaggaataaaggtggtagcaaagtgctgaatggctgcgaagaatggcagttgcgctaagctcgtcggcagggcatgaatcgcatcaagcaatgcgggaaccagcgtgaaaccgatcgtcgttttgtaaatccgggtatttttgccaatccaaggatgaagcaagcctaacataatcagcgcaatggctaatggataaagcagcatcaagatcggcgtggaataggcgataatttgatcgagcccaaaattggcaatcagaaaagcaccaatagttgtgatcggaagaaagaaatgatagcccagtttcggaaagcgatgtcccaaatcctgtgaaaaagaggtgaccagaccaatggcggtggttaagcaagccagcagcgtcatcgctccgagcaaggcagtacctataaggccggtgtaatgcgtcataatttgattaaacgcggtgccgccatttgcggtgatcttagaaaagccgagactaatggcccctaacataatcagcaggatatagatgagtgcttcaagtcccattgccaatgagccaaccttggcaacggctttagcccgactggaagcatgatgtaatcccatcaatttcagcgcggtaatgatggtaacgccaaagcccaacccggcaagtgcgtccatcgtgttgtagccttgtaagaaaccattggtgagattgccggtgataagttttgcattggcagtgaagctaatagctcgaatgtcgcctttaattaacaaggcccagaagaaaataatggccagtaaaagcaacaatagcggattcagcagcttaccgatgtaggtcgtgattttactttcattgcgggcaagcagaaatgttatcaaaaagaaaataaacgaaaaaatcaacaaaccgatttgctgctgccccttgtttagaaagggtgcgataccaatagcgtaagtaacagtggcggttcttggcgaagcaattagcaatccgagactggcatgggtggcaagcaggaagaataaggcgaatccatggcctgctggacgagcgagatcgtacatactactcgcacgggtaagactaatggccatgatggatagcagcggcagtaaaacggccgatagtaagaacccgatggcagccggtagccaagccgctccggctagctgccccatatgaatcgggaagattaaatttccggctccaaagaacatgccgaataacaaagaaccgagtgtgaggtattgacgtttggtgagcttagcttgagttgacattgtagatccctccatgtttataaaatcactgcgacactgaatgctgactgtcgggtattttttccataagaaaagcccttaacagtcagaactgttaagggcgcggatcacgctgtaccaccttactttaccgccaacgtcaccgaaagcggtctcgccgcgtacggcctgattcggcgatacgcgattgctgtaatgggcgcaatcccagccattacttccgaagtcgcaatggcaactcgtagactactttccactagataatcagaggtctcttcccaccaaccgagactcgctgacactgacaatctaggtactcttctactcatcgtttttgaaaatctgttgaattgatctttattttacgaagaagtgggaaaaagtcaaatacttttttaaaaatatgagttagtttgatgagaaatatgagggctaatggggaagcagtacccgttaaaatgcccatataaaggcaatggtgctgctgacatccaaacagttggctagtcatttttcctcatatcaatcatgacatggcctgaagttcacgatagtcacgactggctgaaaaaatcccgcatttaaccaatgaacagaaaaaagccctctcgctcacacatagcgaaaggactttctgattttagctaataaattagccaacaacttcaactgtggctgtcatgacgccagctgaaggaatctgtgagttaggcatcgcgacatccagctgattaggattgccgttagcaaaactaccggtgtcattaacggttcgataccaaaccgtgccatcggataatgtaatcttcaggcgagtcccctttggaaagacggagagattagctgcgacaccatcgtaacccatgcttgaacccaagacggccggatcatagaagcttaacttaaaggtccctttgttagtcgtggtttgggttgtggttgcactagccgcagctgcacttgcgctagccgcctgctgggctgcttgtgcctgagcctgttcctgggcagcctgttgagcagctgcctgttctgctgcagctttttcggctgcggctttttcagctgcagcctgttcctcggcagccttagcagcggccgctttttgctcagcaatttgatgcgctgcttcggcgatatcgtttgtgccgactgtgatggtattttctttcttcgggttgatcagtgaataagtatccgcttggtcagcctttacttcattctttgcctcgttgcttaacacaattgacttagctctaacttgactattgtcactatcattattggcgtgatcagcgatggcttctactttttgtgaatgattacttgtcattcctaatagaggcgccacactgagtaacgcgatgatggataatttgatttgcttagtaaagataaaaattcactcctatattttgaatagtcgtcattttgttcccccgagaacacaaacgaagtatatagggatggtgtgtcaataaaataccagcatcattacaaaaacatctaaattggtaatattgttacgtggatgtaacaaacggaatgttaaaaattttcgtaacaatcactgaacttttccggaaaaagtgggctcaacccttgaagtttctgtgatttgcggcacttttctaccataatttgtgaatttttggaaaatttttgggtgcctaaactttcgtaagtgggaaaatgttatgctaactttatgtcttcaagtcagcatttgcggacatgaagaatgggtggtcaagaccaaagcttggtatttggtggcttgagatggatggattattattgatattttttattcattataatgtgctcccaggtgcagaggacgcttacactccggtttctaaccgcgccggctcgcgctcaccataacgcgctccccggcgcagaagtctgcgtgtaaggacctaaaatgcaatggccaaagcccagccatcacgttttaggccgcttacactccgacttctaaccgcgccggctcgcgctcagctttagttaacgagtttttccataatcaggtataataagacaagacagacgtaacctattatttacaggaacttacaggagcttaaatgggggaagcgtctatttaagggaggacttgaatcggtggcaatgtatcgggagaagcggtttgaagaaatcaagaagctgttggcagcgcgtaatgagctcagcatcgaagatattatgaaggctgttggcgtttctcgtgacactgctcggcgcgatatcgttgccttagatgctcaaggtgttgccagacgtacccgtggcggtttggtgtcgttgaatttcggccacacgattcccagttattcgacccgcttgaaacgtttttctacccagaaaaccaaaatggccaaagcagcgttatcgctgattaaggcgggcggcgtttactttattgatgactcaaccacgcttttgaaattgtcacaatcgattcatcatccagtcacggtatatacgcatagcttggacaacgccattgccctttcagtcgaagaacgggttaatttgcatttgtttggcggtaagctcgatcaccacgcacggtttttctttgagcccacgatgctggagactttgcggcgaattgcttttgatgctgcgtttattggcgccacagcgattgccgaagatggcgtgtatttttcttatatggaagatgctcaggtcaaacaagcggcggcgttatcggcacggcaggtggttgtagtttccgaaaccgaaaaattccagatacaggcaccgtatcgcgggttggaacttggacagattgatacactgattactgataagaaattagcgcaaacgcaaaagcagtggttcccgactaagacggacttcttaatcggtgattaataccaacttaagtaaaaaggattgatatgtattcaatttcagcaaataggctatcaacagcggacacgtcaggaggtgtcgccatggtaacgccacttgtgacgatcattgtgccggtttataaccttgaaagctatgtggcgcatggtttaaaaagccttttagcacaaacttactcccacttacagattattgtgatcgatgatgcgtcaagtgatcgctcgccgcagattgtgacccggtttgcgcaacgggatcggcgcattcaggccatcttaaagccggtgaaccaaggtgtttcggcggcacgtaatagcggactggaacaagctcggggtgagttggttgcgtttatggacggagatgactggtatgaaccggacttcattgcccatgccgttgatgtgatgactcagggatgggatctcattgccatgccgtttttccgtgacgatcccaatccacgtccggttcaagaacatctgcgtaaggcgaagcaattgacaagaaaagggctcatccggcagatgctgcaccccattggttatattcgcggctatttatggaacaaagtgtttcggcgggatgtgattgaacgcctgcaattacgctttgatgaacagatgtccattatggaagacgagctttttaccgccacatatgtgatggcaacgcggcattttttgtataccggacatccggcgtatcatcatgtcgtgcgacgggattcggccactcaatcgttaggtgttctgggggcaatcccgcagcagctctatgcgttgtggcgcattcatcatgtgttgcgccatgcccaccgctacgaaaagggtactaaaaaagaagcaattaaaattgaccattaaaacaaaggagtatggatgttgaccgagaatttaatgacttaccgagagctcaagcataaggccaaagaacaactaaagaccgggacgaatcgccgcgatttgatgctggcttatctactgccgagtttgttgcaggcggcagcctcgattgttgcttatttggcgattttggcggtgattcagagcttcggggtagaaaaaacactgacagatccaaatggctttcaagcgtattatatgcaaagtggcaacaacaccgggacactcaataccattcaaagtctggtgaataccatgctggtgcaaggggttaactttgcggtgctggatcttgtccggcatcagacgcgcgttcatccatttcgtgcggtattgggtctttttaacggcaagtggttctggggttcgatttcgctatggatctttacctatttcctgacgcttatcggcttttccttcctcgttattccaggtgttttgctgatactgggatggcggcaggctttttgggttttcaaagacggacatgaagcagatcaacgtttctcatcgatttcggcattgatcggctcatggcggctcatgcgcggttttaaagctaatttgctcgggttgtacgtctcgttaattggctggtacttgctggaaaatctgacgttccacctttttgactgggcgattaatccctatcttcaactcgtgcacgctaattactatgagaatcggcgtgcttataaaatggcggcgcaagcgtagtccttttggcgtgtctttttaaccgcagcggcgtatactggcggcgtctaagtttatgaaggaatcagacaagtgagaaggatgggtgcttttaccatggaaacagaagcatacatgaccttggctgaagtcaaaagccggcagttggcattaaaacggcaggtaccacttgatcaagcgattgcagagaatattcagaactgggcacagtggttgttggacgaagggtttgaaggcagttattttactgccaagctagagggggcagctattttgattcgtgatcttaatggacagctagttgcaaccataacgactgatgcgcctagttatgtgacggcgttcaagcaggctgatcggatgacgatgctcgccattcaaacgaagcttcggcgtttaattgatcagcacgggctaaccctgtcgtgattgagcgcaggttggctgacgactaaggctgagaaaatttcatgacagaaaagcagcgatcaaaaaaataccatccgccgttactgaagtgagtaacgacgggtggtacttttcgtgtatcttataaatcaaaaaatcttcaagcgatttagcggccaatagcgccaaacgacgactgactgaattttggatttatcaacgaatccaaagtcacgactgtcatgcgaaaccaaccgattatcccccatgacgaaatacttgccagcaggtacttttgctgacttagttgaagatagggttttgatgttgaaatcgttggtgaatttaatcgtggaggaatccagcccttgttgactggcccattgattaatttccgttcgtgcaaatttgtgattcaagtaaggctcggcaatggcctttccgttgacgtaaagcttatcgtttttagcgctcaccgtgtcacctggcatgccaatcacacgtttaatatagagggattttggtcgatcaggtgcatttattacgacaatatcgttgcgtttgggctgcatgacgcgaacggaataaagccgttcgccgttttccaatgtcggctgcattgacgtgccttggacaacatctttgctgacgacatatttcatgagcagctgggtcgcaaaaaagatgacgatgaagagcacaagaaattcgagaatcgttcttaagacggaatgactgttatttttcacgatggcaccttccggtagagatttacttaagtctaccacaagccttgtcgccacgactaaaaagttcgcttgtcaattaatcatatttcgggaaaaaaacgcttttttcagcttgccggcagagatcgacaatctgggcatattccgccagtgtcaaacaccaacgatgcggtaagcttgtgtacccataagctaacccagccaagccgccggttaatgccgcagcggtgtcggttgccccaccaagtgcaagtgcgtgtaagacggcatcgtgataatccggccaagtcgaaagcgcatgcaacacccgaacgagcagacttaaaggatcggttgccgtagcatcaagtgaggtgggtgccgcgagcagagattgaaatgagtcaaaaaccggttgttccgcctgcttattggcaaaatagtcgccagccttggtgataccggtagcgatggcagttggcaggtccggggcatccgcgagtaattcgatggcgatttgggtgtaaatagccgttgctaccatattctccggatcggtgttggtgagggtgacaaagttttgaaagagacgactaccctctgcttttttgaatagatctgtgtcaaatgtttgataagcaaaaaaagcaaatggtaaagcgcggatcaatgctcctggttcgttaggcgccgccgcagcttttccagtggtcaaagcagttgccacactaggccaaatatcgggattgcgttttccataaggtgcgtgttttccatttttaaaccacgcttggtaagcagcgattagctttgcctgatcaaagccggattgtaaggcgtctaggccggcaagtgtgaggccggtttcatcggaatacgtgccggctggttggttgaaggtgccataacccttcatggtcgtgactggcgcagcagccagatcggcctgcgactgccccttaaccggtaatcccaaagcgtcaccgattgcaaacccaaccgttccgtgaatcaaacgagattccatgatccccatttttgccatctccttatcaaaatactggttcatgcatgtcgcatttcaagcagttgtcaccacaaaaaccgcgatgaggtagtaaataccaccgtctatttaatcggctgatgcagtcattatttctccggagaagcagaaaatgcaaaaaatttgcctcgttgtcaaacatcaaccgctgtgatagcctagctagcagtagctattttcagaaagctgccgtgttgagtgcgttgacggccggtttgaattcggcctgaaaagcatactggcagcgagataatgggcatgatggggcatcataacagtgtgcggatggtttgaaaagccaaaaccgcggcgaatgagagtacaagcttttttaagataggcttcaaatgatggcgtcagtaatgcttggcggtttttatagaaggagaatgaaatgagtgttttaaccgtaaccgggttatcgcagcggtttttagacaaggtgttgtatcaagatgccagttttcaggtgaatattgaagatcatctcggtgtgattggccaaaatggcgtcgggaaaagtaccttaatcaagattttgactggggccttaacaccggatgcggggaagattatctggcaaaagcatcttcatgtcggctatttggaccagtatgccaatttggtgccgggacaaacagttattgagtttctgcggaccgctttcgatgagctttatcgtaaagagaccaagatgaaccaaatctatgccgattatgcggctcacccggatgatgagcttttagcgaaggctggtgaattacagcaagagcttgaagccggtgacttttatgagctcgaaaccacgatccagacagtggcagaaggcttgggcatcacggcgatggggatggatcatccggttgatgctttgtctggcggccaacgctcgaaactaatcttggcgaaactgttattggaaaagccggatatgttattactggatgaaccgacgaattatctggatgtttcgcacatcgcctggttgactgattggctccagaactttgaaggagccttcattgtgatctcccatgattttgactttctcgaaaatgtgaccaatgcggtattggatattgagtttggccaaatcaccaaatatacagggactttaaaacaggctatgcgtcaaaaagaagctgaccacgagacgtatctgaaggcttttgccaaacagcaggagacgatcaagaaaaccgaggcctttatccgcaagttcaaagccggcacccgcgcaaccatggctaaaagtcgggaaaagcaattagcccgtatggataaattgacacccccgggtacgcgagcaaaggcgcatttagcctttccgtatatgccggttaaccgccaaatgctagtggacgttaacgatctagtcgtcggatatgataagcctttgttgcagccgattaatttttcggtggctaaggatcaggtgattgcatttgaaggctttaacggtgttggtaagtcaaccttattgaagacgattctcggtttgttgccagcactgggtggtagtgtcgagattgccgacaatgtcacttttggctattacgaacaagaactgcactgggatcagcccaagcaaagtccggttcagtatttgcaacaacgctttccggccttaacccaaaagacggtacgccaagtgttgtcacgaaccgcgttgacaagtgaggaagccaataatccgctaacgatgctgtcaggtggcgagcaagctaaagtcaaattggctgatctcatgttacagacaaccaatattttggtgatggatgaaccaacgaatcatctagatgacgacaccaaaaatgcgctgcgaaccggactgcaacagtatcccggcgccgttttactcgtatctcatgaagcaggcttctatgatcattcctgggtcgacacagttgtcaatgtcgaacaatttcaagtcaaagaatgatagcggacaaaggctagttacgatgattaatggcggtgcaacaagctaggacaccaaaatcagacgacacctgagcgaatgcgatggtgtctttttatatacgcgcaataaatgaactgatcggcgggggcacgcttaattcttgggatgccacatcaattgtgtatatgcataggtcaggtgatcggttaccggcatgtgcggattttcatgaccggtcaatgctttagccacacgttccgccgccttgacgcccacaggtaaaccaagttcgggcagcatatcactgacagtcgtttgctcctctaggtggtaagtcagcgtgtgcgtttcaaatggaatttgatgtaagcttaaccaattttgatagccggcaacgcgacttggatcggcttgataagcgaccggcatatcgtggcctaaaagagttagagcgtggcgaaccaaagcatcatcttgctgtgtttgaaagttcaggatgactgtttttcgcgccagagcgtttaaaagtgataactcttccggcaatagcgttggcagttgactgacaaagacaagatcagcacttgtcgatgaaacaagttgatgccaatcatcggtgagataagtcatgcttgtttttttgttggctttcaatcgggtttttgcatatgtaagcatcgccgaagaccagtcaattaaggtgaggtgacggacatacggggccaatcggatagcaaaacggccggtaccggcagcaaggtctatcaatgagtcggctgggagcaacccattagcgatcatccaggtagtcacatcatgggcaagcggtagccgggaatcttgttcagcggcagcatagtctgcggcgaagtgattccaaaaatcacgatcttcctgcataagaaaagaggtctccttttttgaaaaactttttttaaaaaagttgttgacttgggatgggaaactgcgtagtatagtacgagttgtcagtcataaaacattttaagccgctcagcgatttaaaaaaagatgttgacaaagagttgccaatttgatactctaattaagttgtcgcttggcaacaaagtagtcctttgaaaactgaacaaagtttcgtttaaatgtgcagggtccttgatacttcggtatcgaggcaaaaagtaacatttgcgaagtcaattcgctagaacaacaaatcgagctattcgaacagctcatatttatatgagagtttgatcctggctcaggatgaacgctggcggcgtgcctaatacatgcaagtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaaaaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggattaccctcaagcaccctagcgggtacgactttgttctttgaaaactggatatcattgttgtaaatgttttaaattgccgagaacacagcgtatttgtatgagtttctaataatagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcctgcaagtgaatacatagcttgttggcggcagacgcggggaactgaaacatctcagtacccgcaggaagagaaagaaaactcgattcccatagtagcggcgagcgaagtgggaagagcccaaaccgagaagcttgcttctcggggttgtaggactggacattggagttaccaaagttcgacgtagtcgaagtcagctggaaagctgcgccatagaaggtgaaagccctgtaaacgaaacggcggactctccgtccaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaacagttcctgaaaccgtgtgcctacaattagtcaaagcccgttaacgggtaatggcgtgccttttgtagaatgaaccggcgagttacgtttgcctgcgaggttaagatgaaaagtcggagccggagcgaaagcgagtctgaacagggcgcttcagtaggtagatgtagacccgaaaccaagtgacctacccatgaccaggttgaaggtgtggtgaaacacactggaggaccgaacccatgtatgttgaaaaatgctgggatgagttgtgggtagcggtgaaattccaaacgaacttggagatagctggttctctccgaaatagctttagggttagcctcggaggatggatcatggaggtagagcactgtttgaactaggggcccgtcaagggttactgaattcagataaactccgaataccattgatcttactccgggagtcagacagtgagcgataaggtccattgtcgaaaggggaacagcccagatcaccagttaaggtccctaaatttatgctaagtggaaaaggatgtggcgttgcacagacaactaggatgttggctcagaagcagccaccatttaaagagtgcgtaatagctcactagtcgagtggcactgcgccgaaaatataccggggctaagcataataccgaaactgtgggtgcacccgtcagggtgcgcggtaggagagcgttctaagggcgttgaaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgcaaggcgtagtcgatgacaagcaggttgagattcctgcactagtttattttgtttaagcgatggagggacgcaggaggctaaggaaagcgcacggctggaaaagtgcgtccaagcagtaagtccggtagcgagtgaaatgcttgccgccttaaggacaagctgtgatggggagcgaaattaaagtagcgaagttcctgatgtcacactgccaagaaaagcttctagtgagaaataaactacccgtaccgcaaaccgacacaggtagtcgaggagagtatcctcaggtgagcgagcgaactctcgttaaggaactcggcaaaatgaccccgtaacttcggaagaaggggtgctgaccgcaaggtcagccgcagtgaataggcccaaacaactgtttatcaaaaacacaggtctctgctaaatcgtaagatgatgtataggggctgacgcctgcccggtgctggaaggttaagaggatgagttagcgcaagcgaagcccagaattgaagccccagtaaacggcggccgtaactataacggtcctaaggtagcgaaattccttgtcgggtaagttccgacccgcacgaaaggcgtaatgatttgggcactgtctcaacgagagactcggtgaaattatagtacccgtgaagatgcgggttacccgcgacaggacggaaagaccccatggagctttactatagcttgatattgagtgttggtaccgcttgtacaggataggtaggagccgtagagatcggaacgctagtttcgatggaggcattggtgggatactaccctagctgtatgaacactctaacccgcgccactaatcgtggcgggagacagtgtcaggtaggcagtttgactggggcggtcgcctcctaaaatgtaacggaggcgcccaaaggttccctcagaatggttggaaatcattcgcagagtgtaaaggtagaagggggcttgactgcgagactgacaagtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgttccgctggtgtaccagttgtgccgccaggcgcatcgctgggtagctatgaacggaagggataaacgctgaaagcatctaagtgtgaagcccccctcgagatgagatttcccattcctatatggaagtaagacccctgaaagatgatcaggtagataggctggaagtggaagtgcagcgatgcatggagcggaccagtactaatcggtcgaggacttaaccaagtaaagcgcaaactggcgctaagccagcgcgcgtttcgatgaaatacgttaagttccggcaaaaacaacaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgcaaagataagatccggtcattgaccggatcttttttcgtaactaataattcaatgcgacgaatttgatgaaagcgttgaagaacgcttgaaaacactcattaatgagtgctaaattgcaagagcaggtatagaaacgaggtctggataatgccaacaaatgcgacaaaggcaacactaaaatctttgacagccagaggcactgttgttgttgatttttgggcgccgtggtgtggcccatgtaaaatacttgagcccatattaacggcattggaggcggagttatcaggcctaaccattgtcagatacaatgttgaaaaagatccttccttaccacagacgatgggtattatgtcggtgccaacgctggtggtttatcaagatggtcatgctaaggaaaaagtgaccggtgtctatgctaaggagaaactcaaacgttactttgaaaagaagctagaggccgggcgatgacaaacgtgatgaagcaaagtaaggtgaatgaccaaaatcaggttctagctacatgcttattagcgggccggattatgattgaaggcggctccgagatgtatcgtgtggaagatacgatgcggcgaattgccgttaatgcgggacagccggataccttggtttttacaacgcttaccggaatcttcgctagtattgaaaaccaaccctatattcaggaacgcccgattaacaagcgatcaattgatatggagaaggtcgcccgcgttaatcaattgtcacgcttgtttgcggcaaaagaaattgatttgggtgacctgcatgcggctttgacgcagttggatcagaataccccgttttttccaatatcatggcagattctgagtgctgccgtggtgagtgtgacgctaatgattctgtttgcgcaaaaatatgattggtttgatatccccttagcagctgttgttggtgcgatcggcttttgggtcgatatcaaggttaatacgatcacgaatatccgttttatcagtgaacttttaggtgccttggctgtcggattaactgcatggattggcatcaggctgggatggggacatagcctcgataacattatcattggtgccattatgccgttggtgcccggcgttgccattacgaattcgattcgtgatatgttggctggacacttgttatccggcatggtaagaggaatggaatcgattctcagtgcttgtgccattggggttggcattgcgattatttttcgattcttttagtaaaggaggcaggcggtttgtcatggatattcgcgttacttattcagctatcttttagttatttggcaacggtggcgtttgcgattatcattaatgtcccgcgaaaggcgcttaatctcgctggttggtcgggaatgatgggttggttggcatactggctgttgatggaagcaggaatcggacggatgatggcgaacctgactggcgcttttgtcattgggctatgcggtattttttttgcccgctataaaaagatgcctgtgattatttttaatatcccgggatttgttccgcttgtgcctggcgcaattgcttatcaggcggtgcgtgcagtcgtgatggggcaattgaatgccgccttgcgttatgtgagccgcgtcatcatgattgccggtgcgattgctgtcggcttcatgttggcgcaactgctgtcggaattattatacagacgcgctgttttgaaacccaaaaagtgatacaatacttatatgcgatgagtcgagtaagcatgtatcaatgctgaaagaagcagctgacaggttaagagccacccgccggatttgtggggtcagcgatctcaaggttgtggagccagcgagatcctatccaagtttttggatactgcaagaggcagtcagataatttatctggctgctttttttaatgctcaacaggacagcttgtttttaatttgttttttaaaaagtttttccacgaaccaacctgttatttattaacaaaattatcagaaatagcgtacagttttctgggctgaaaatcggcgtgaatataaatggattttgcgtcatgatacagacaaagatgtctcaatgtaaatgactatcaaaaagtttaaaaattaagttgactttttaagtgaaccagattaatattctaaccaatcattaatcttacttgaaagaaggcgggtctatgtcagtcatgtgtatgtcagcaggcacgatgtctgttggggttattaatcatttagccttgttgttgatgtcagggacccgaccgtttgatcaatagcgatcagcgtatcgagccccgtcttcgcattggcaatggggcgctgatacaggcacccattcgttggaatgggtgccttttttcttcgagattaatgacaattcgcggatagacgcaaagggggaaccaaaatggcgaaaaagtttctaaagacgattatcagcacagggatgattgcggcatcagtattggccttatcaggatgtgcgaccaaaagtgctgcgaataagggtaacacggcgggcagcaccattaagattggggtcaatatggaattatccggggctgtagctggctatggcgaacaggaaaagcaaggcgttgagttggcggtcaaacagattaatgcagcaggtggcattaaggttggcaacagcaagaagaagatcacggcgatttatcgtgataacaagtcctcaaccagcggagccgcatccgttgctgctcagttggctaatagtgataaggcggtcgcaatcgtagggccggcaaccactaacgacggcacggcatccatcccgaatgtaacaaaggctggggtgccaatggttggaccaagcgcgacggatccaaactttaccttgcaaaaaaatggcagcgttcaaaagtatgttttccgcgcttgtttcaccgatgccttccagggtgaaaaagcagcagtctttgctaacgataccttgaaagctaaaaacattgcaatcatcgctgataactcgactgattacggaaccggtttggcaaaagcattcaaaaagaagttcgccggcaaagtggtcgcgaccgagtattatcaatccggcgataaagactttaacgcgatgctgacgaatatcaaaaataaaaaaattgatgccatttacgcacctggctattattcagagcttggccttgtgatcaaacaagcgcggcaggcaggcattaaagtgccaattattggtgccgatgggatggctgatccaaaacttgccaagattgccggagccgaaaatgcaactgatatttattacaccacgccattttcaacgctgagtgcaaatcgcagcagcttggttaagaacttcctagctaactacaagaagcaatacaacgcaaacgccccgacgttctcggcactggcttatgattcggtttacatgatcaagcaagcgattgaagatcaaaagtctgctgattcggctagcatcgcaaaaggcttagctaagatcaagaatatgcccggcgttaccggtaccacaacgattgatagcaagcataatccggaaaagccgattgcggttgaagaattgacacaaggcaaaatcacaaaggtgtatacggttaaataatgcgcctgttggaattgcaaaagggggttacatcgcttgcagaccatgatgcaacaaattatcaatggactttcactcggcagtatttatgccttgcttgcactgggctacaccatggtctatgggatcatcaagttgatcaacttcgcacatggtgatatctacatgctcggtgctttctggggctattacgcgattaattatctccactttgggtttgtgacggcgctattgtcagccatgttgatggccagtctttcaggggtattaatcgaatatctggcttatcgcccgttacgtaactcaccgagaattgccgcattgattacggccattggggtttcctttttccttgaaaatgggatgtcgtttttgtttggcgcgaatgctcgtaattttccacaagtcattgcgactaaaacgtatcatctcggcggggtggatatttcaaacgttcagttgttgattttattcacttcgctggttttgatgatactgcttcaattcatcatcaaaaagacaacaatggggaaggcgatgcgtgcggttgcggttgatccgcaggcggctcagttagtcggcattaatccggatcacgtcatttcctttactttcgcgttgggatcggcattggccggggcggctggtgtcatgatcgggctgtattacaactcaattgatcctttgatgggcatggtaccaggcatcaaagccttcgttgctgcggttgtcggcggtattggctcgattccgggagcggcgatcggtggcttcttgatcggtctgcttgaaaccggtgtccaggcaattggcttgtccgcttataaggatgcggccgtttatctggttctgattttagtcctcgtcgtcttaccggccgggttgtttggcaaacgtcaacgagagaaggtgtgagctgatgcttaaaaacttacgcagcaaattaatctggttggcgatcatggtggctggctttgtcttgatcgatattggcgagtttaccggaatcgtcaacagttttattgaaaatgcgctcgtcacgatcggtatcaacattattttggcagttggcttaaacctcattatcggcttttccggtcagttttcattgggtcacgccgggtttatggcaatcggagcgtatgcgactgctatcgtcacgcaaaatatggcgaccccgcttggcttttaccttgccatgctactggggatggtgattgccgtgattgccgcgttaattgtcggcattccgaccctgcgcttgcgtggtgactatctggctattgcaacgatgggggcggccgagattattcgcgttattatcaataatctgaaaatcaccaatggaccagcaggcatgttcaatattccgccgcttgcgtcttggcccacggtatacgtgttgatgtgtgttaccaccgtggtcattgtcaactttgttcatagtcgctcaggacgtgcgatcatggcgattcgcgatgatgatattgccgcagaatcgatcgggatcaacccgaccaaatggaagttggccgcgtttgtgttaggtgccgcaacagctgccattggcggatccttacatgctagttatttgcagaccattgcaccaggcgactttggcattatgaattctatttcactcttgattattgtcgtgctaggcggtgtcggtagtatgactgggacgtttgtggcggcaattgttctaggcgtgatcgacacggttttgcagaacttcgggacgttgcgcatggtcatctacgcgttggctttgattttgttgatggtctttaagccgtccggacttctgggccattatgagctttcttttagccgcaaacggcgcgcgcgaaaggaggcggcgtcatgaccaagcaattggtagtcgagcatgttagcaaagtctttggtggacttaaagcagtggcagatgtcagtttaaccattgatcaaggttccttgattgcgttgattgggccaaacggtgccgggaaaaccacgctgttcaacatgctgaccggcgaatccggaccgacaaccggtaaaatcacactcaacacagcaaccggtgccgtcgatattaccaaaaaaaaggcctttcaggttgctaaactaggcgttgcccgaacttttcagaatattcgactgtttggggcgatgtcggttaaggaaaacgtcttggtggctagaacccacctgtatcacgaaagttttctgggaacggttttgcgcttaccgcagttttatcaaaaagagcaggcagtcggaatggcggctgatgaattgctcacctttttcgaactcaatgatgtggctgatgaaccaactgccagcctgccatatgggacgcagcggcgagtggaaattgtgcgtgccgttgctactaagccgcaactactttttctagatgaaccggccgcggggatgaatcctgaagaaacggctgatttaagccgcttgattgctcgggtgcgggagcattttggcattacggtggttttgattgaacacgatatgtcactggtcatgaatctggcagagtatatctatgtccttgatcacggggcgatgattgctgaaggtacgccacaagcgattcagcgcgatccgcgggttatcagtgcgtatctgggaggtgaggtgcatgcttgatgtcaaagatctggtcgtcaattatggcgggattcaggcagttaaaggggtcagcttccgcgtgcaaaccggcgaaattgtggccttgattggggcgaacggggccggaaaaagtacgattctaaaaacaatttccggattgttacggccgcgttccggcactatcctgtatgaagacaagaacatcgtggggatggcagcagccaaaatcgtgaaaatgggcatctcgcaagtgccagaaggacgccacatttttgccgggttgacggtgagtgagaacttgcagatgggggcattcggactaaaggacaaacaagtcgccagtgatcaactggcggtcgtctatgatcggttcccggttttaaaagaacgtcgcaatcaagacgcggcaaccctttccggtggggaacagcagatgttggcgatgggcagagcgttgatggcccgaccaaaattactcttactcgatgaaccttcaatgggcttgtcaccgatctttattcaggaaatttttgatattattaccaagattaaaagccaggggacgaccattttgttaattgagcaaaatgctaaacaagcactggccgtagctgaccgcgggtatgttttagcaatcggcacgctgaagttaaccggaaccgggactgatttgctggcagatccggcagttcaggcgacttatctgggagcgcaaccagcgaccagctgaggcagataagatgttattttgcagacgagcagcgattggagctgctcgtcttttttataaaaaatattatatcgattgatgtacgcgtgtagcatgatatcggtagatcaaggacatcaacaccatcgcatctgctttggtaaccttgaaagggaggataaggacttgaacttaatcgcgcaccaacagtggctggtggacttttacgaaaagcgccactggtatcaatattcaccgttcattcggctcaactttctcacagaggaaaccggcgaattatcgcgggttatacgagccattgaaatcgggcgtgatcatccgggcaagccggttcaaaacgaagcggatctggaggctaacttaaaagaagaactagcagacgtgttggatcaggttttaatcttgagcgctaaatttaagatcgatcccaatgatttgttggcgcaaagtgaacataaattgaaggcgcgttttaagaaagatgtttgagccaaggtgattgcttcgatgaacagtgagcacttggattgtctgaaaagtgtccatagaaaaacggttccggcaaactgatgccggaaccgtttttgcgcggagcctgttagaggtgattattgattttgtcccccatcgcccggtgctggaccaacaccgcggccgctaccgcctgttcccggacgaacgccttgttgatttggtgttgcaaccatgtattgactgatcagactaacaatctgccggttttgcggcaaagcgctatggttggcatcatcgcctgagacggtaatctgggtataatgggcaacctgattttggaaaatatacttaccggcttcgacactttcgatcggcaccgtgccatcgccatccaacgtctcggttccggcaatcgagtaaacggttagactgctcggaagcttgttgcgactggttataaagtcattgagcatctgcgtccggttatccggattactttcttcgaggttatacggggtgccaatggtcattaggcgggtcatttgaacatctgaatcgttgtaatatttttctagaaaaagcgtgaaaatgagtccgccattactgtgaccgataccgcggaaccggttgaaattgtaagtctttgccagctgcttaaacgcaatattgaaccattcggcctgtttcttaatattgttgtaaccatctttattattttcaaatgccacaacgatataaggttcggtatcacgggctgcgattttgccactataggtcatggtgccatttgtcttcaccgtgatctttaaaagactatgaccggttgtttgcgcattgagttgcgtgattaacgtgttaaaacggtcttcggtggccgaactccccggaattaagataattggctgcattcgggaattgtgaaccacacgcgcagatttaacgttttgcgccatccactgagttgcgggaaacacgacagcacccattgcaagtacgctgagaacaagcaaaagccatttgcgccaatgtttaatcatgatgaccacccacttttgccgattcaagattgatggtttcggctaaccggacaaacgggacataaatgaagactgaaatgaccagacacaagactgcgactaataatgcgacaagattgccattggttcccagaaacgcgattaagggtccaggggttgtcgccgggaccgtgtaaacggaaggcggcataagatgcagtctgatggcagtccaggcaatggccatgttgatcagcggggtgattaaaaacggaaccagcatgatcggattaagcatcaccggccagccgatcagaaccggtgagctgacatttaccaaacccggaaacaacgataactcggcgatgcgacgtgatgcctttgaccggccgacccagagcgtggcgataatcaatgctaaggtcatgcccacaccgccaaagctggcaaacggacgataaatcgtgcccatcgtgattggattgggaacgttaaataaatcggcatgctccaacgcataattcaaattggcggttgccgtggtgctgcctgattgaaccatcaacggattaatcggaccttcaatcccggcccaccacatcaaagcattgatcgttgtgacaagcgcaagtcgcagtgaaacgtgggttaagtgagcagccgggaattgaaagaccacgtaaaagaggcccacaaacccttctgttgaaacaaaaccgagtccgtaattaatgaccacacagctaatgagtatcaggaccatcatccaggttccccgtaatccgcgactgacgagcccggcgatggtatagcgatgtgaaggctcttctaagtccgcccgcgtgaagcgaaaaagccaaccgatcaataacccgaaaataattgcaataaacaagccgcgatagcccagattgttcatttgaaaaactgattgggcattccggcgtgtttcaagattgagaattaaaaaggcaccgacgcttgtgacggcagctagagaatcgtccttcttatacgatcgtgcaacatacttggcaacaaaaaaggcagtcatgacggccattaaattaatggtgacattttcgatggcgatcaggagtgtgcgcatctgggtataaaaaggaatgaccttgttgagattataaatgacggcaaaaaaaccgttacgcgaaaaaacactcaactcaagcatttgtgcccatgcgccgatcacgacgaacggaaaaatgacagcaaaagtttgttgaagggcacgataagttcgagtttgccgcagccgaacactatttgctacgagcatcggaagcaatctttttgtgagattgctcatgactgccatctcccttgatttgttgaacacctattactgttattctaacaaatattattgtaatcgagtagttttatgacggacagggcggcgggtttggcaaacgagaagatgacacattgacgaacgtgacttgagcaatggcgatgggggttcacttgttacttttgttgcagcgtatgcaagtgactcgttaccatggtatccttaaagctggaaagcaaaagacgttaattagaaagcgcgttcataaaggcagtatcgctattcttgcgccacgtgaatacgcgcgtctaaagcatgatggaggcataaaaatggataagccattggcaaagtatattgatcacacgttattaaagccagacgcaacgcaagcccagattgatgtgattttggatcaggcgaagcaatatgattttgcttcagtgtgcattaatccttattgggttgtgcgggcagcagccagtctacgcgacaccgatgttaatgtttgcacggttattggtttcccacttggcgctaacacgacacagaccaaagtatttgaagccggtcaagcagttgacgaaggtgctaaggaagtcgatatggttttaaatatcggtgaactgaaagctggtcatgatgatcatgtccgcgcggatattcaagcagttgccgacatcacgcatgcaaaaggcggcattcttaaggtcatcatcgaagcagttctattaactgatgatgaaaaagtgacggcatgcaaactcgcagctgcagccggcgctgatttcgttaaaacgtcaaccgggtttgccgccggtggtgccacggttcatgatgtcaaactcatgcggcagacagtcggtgatcaattaggtgtcaaagcggccggtggtatccacacctatactgaagccaaagcgctcattgaagccggcgccgatcgtttgggtgccagtgccggcgtgcagattttaaaggaagcaggggaagcttaagatggcttttgatcgaatcattaccattgtcttagattcaattgggattggcgaagcaccggatgcggctaaatatcacgataccggtgccgatacgcttggtcacattggcgattattttgccgggaaattatcgttgcctaatttacaggcaatcggtctgggcaatatcgaccgccctacgccaattgctggggttaagccattagggagtccgagtggttattttggcaagatggccgagatttcggctgggaaagatagtatggatggccactgggaaatgatgggtctgccggtgacggaaccgcttggctattttcctaatggattcccggaagacttgattaaacaaattgaagaattttccggccggcatgtcatcttaaataagccttattccggcaccgaggcgattaaagactacggtgaagagcagctgaaaaccggtgatctgattgtttatacgtctggcgattcggtcttgcagattgcggctcagactgatgttatccccttagaggaactgtatcggatttgccgttatgtccgcagcatcacgattgacgccccatatcgcatcggccgggtgattgcgcgaccgtacgtgggaaccgatccgacaacctttacccgtaccagcgatcggcatgattatacattgaaaccggataagcccactgacttggatcgcttgcagggagccggtgtgccgacatatggcattggcaagatcaatgatattttctccggacaaggattggatgatggggtgcacacggttagcaacgtggatgggatgaatcaaacgattgccgccgtaaaatccgatcgcaaaggctttattttcaccaatctcgtggatttcgatgcgatgtatggtcatcgacgtaatgctcaaggcgatggtgacgcattaatgacatttgaccaccagttaagcgatttgttgacggtgttgcggcgtgaggatttgcttatgattacggccgatcatggtaacgacccgacatttcgcgggacagatcatacgcgcgagttcgtcccattactagcatatagcaaggcattagccggtaacggggatctgggtatccgttcgccattttccgacttaggggccaccattctcgacaatttcggggtcaccgggaatcgggtaggtcaatcgtttttgagtctgcttcgctaatgaggctaggatccggtagttgtagttgcaatcaatccggatgatgacgggtagccatctgacggttgtcacttgcttgtcgttcatttgtcgacccgaatccaactaagggggaattttcatcatgagtacacatattgacgctccaaaaggcgccattgcagatgttgttttgttaccgggcgatccattacgcgcacaatatattgccgaacattttttggaaaaggctgtccgctacaatacagtgcgtaatgcctttggttatacgggcacctttgaagggcgacggatctcagttcaagcgacggggatggggattccttcaatttcaatttatgttaatgaacttattcaggattatggcgtcaaaacactgattcgagtggggactgccggtgggatgggtagcgatgttaaggtacgggatgtcattctggtacaaggatcatcgacagacagcagcatcgttttgaatacgtttggggcggggatgtattttgccccaatagccgactttcagcttttgcgtgaggcagcaaatttggcagatgctggggcattgcgctaccatgtgggtaatgtgctcggagaagatcgcttctacaacgatgaaatggatcgtcaaaagctcatcgattacggcgtgttagccaccgaaatggagacccctgcactatatcttctggctgcgaagttccatgcacaggcgttatcaatcctcaccgtctcaaatcacctgatcaggggtgaagaaacaacggctcaagagcgtcagactagctttaatgacatgatcgggttggcactgggcgtcgctaaaaagattcctgtacgttaaataacgtataagttgaaggcatacctgtgtaaaatgacggtttaaaattttccggaaatagcaaattaatgtgcgaagaagtaggaaacgtgttattctgtatatggtttcttaagaaaaggtaaatgcaaattaaagtgtaaatttagattcgtacaattattcagtttagaaatggaggagtacatacatggtagattctaagaaagtattgtcagtaacggcaggcttcgttggtgctgccggtctggcggctttagcaaccggagccaataccgtttctgcatcgacagggacggtcagttacaaatccggtgcgaccaccgtatggaatagtccatcatggcaccaagtcaaacgctacgtgacttttggggacacggtgcagctattgggtaaaaccgttgaccaaaatggtgctacttggtataaagttggcgacaatcagtggattccggaattgtatttgaatgttgcgggtaaaactgccacggttgaaacaccgagttcggcagcaagtcaaactgctgtcagccaagcaccggctagtcaggcgcctacaagccaagcaccagcaacccaaacacctgcagcaccacaaaccgatacccaaacagctaatacacagctttatgtcaagaatatcggttcagcagttaccgtatggacaaccccggcgtatactcatgcgacaggtcaatatctagaaggcagccagacactgacggctgttgcccagcagcaagcaaatggtgaaacatggtatcggcttgccaacggcggttatgttcctgcacggtttgttagcacaacaccagtggctgtaacaccacaacctgcagcgccacagtcaaatgaggccagtgttgcgtcaacgaacaccaatgcagctaatgattctgccgctgcttctagtgcagccgcatcgcaagccgcagcttccagtgctgccgcttctacagcagcagctaatgcagcagtagcatctgcaaatgccactgcatcacaagcagcggcttctgaagctgctgcatctcaggcggctgcatcacaagccgcagcgtctcaggctgccgcatcgcaagccgcagcatcacaagctgcagcgtctcaggcggctgcatcacaagccgccgcttcacaagctgcagcgtcccaggctgccgcatcacaagcagctgcaaatgctgcccagcaggcgccggctaaccaggcaaatgttacaacaacacaggttaatgccaatcaagctcaacagcaaaccgctacggctacaccagcagttaacacgtctaatcagacggcggccgtaagtgcttcaagacaggccaagattcaagcagtgattgccattgccgaacaacaagttggtaagccatacgtttggggcggtaaggggcctaacagctttgattgctccggtttgatgtattacgctttcctgaatggcgctggcgtcaacattggtggctggacagttcctcaagaatcttcagggacacaagtttcactgagtgctctgcaacccggtgacttactcttctggggtagtcacggttcaacctatcacgttgccctgtacatcggtggcggcacgatgattcaggcgccacagccaggtgaaaatgttaaatataccgcgctggcatacttcatgcctgactttgcggttcgcccgtcactataagcttaatgatcgaatgaagaatgcaagaacatctctgagtcgttagaggtgttcttttttatattaaaaaaccagacagttccgcggctcttagtggctgcatgaactgtctggttttgtatacatgacaaaatattcgtaaagcgagttaggctaccggtgttgtcggcttctttttagccttgtcaactgccgccatagccacggcatttacccagttaatcggctgatcgaagttaggttggaagagcatgtcaaccatcgcaagtgtttcgatcgtcatgtgggtctggatcgcaagcgaaatgacattagcgctttggctgatatcgtgcttggagaaaaaggcacctcctttaacttcatgcgtcttgggatcccatgtcaggctgcagagcaccggcgttgtggttaacatgaaatcggggcgataatcctgttcgatcgtgacactatcaagctcaagtccacgtgtgtgagcgccttccaccgttaggccgcttgccgcaatggcgtgatcaaaaagttcaacggccgagctagattgtgttcccaggtatttttccgtgggggtcatgatatttttaccaacaagaatgccttgacggactgcgttggtcgcaagcgggatgtagtcatttttgccagtcggattatagtggacggtagcggtatcaccagcagcgaaaatgtcggggtcactggtctgcatatatgcatttgttatgacagcgccattaggcagggtgtccagatggtcctttagcagatccgtgttcggacggaagccggtacataaaattgcaatatccgcggtatagtcgcctttattggttgtaaccttgataccctgatcagcttgtgcgaactcggtaaccatctcattgagtgccaagtgaaccccgtgatcggtgtaaagcttttcaacgcgatccgtgatagtggcgtcaaagtttttcgccaaaacccgtggaagtccatcgattaacgtgacttctttgtcggttaacgcaaattgttcggctaattctgcaccgatgtagcctgcaccgatgacaatggcgcttttaatggacggggccagatcttttagcgtcttggcgtcggaccaatttttgcataagtagacgtttgaatcgtggataccgggaatatttggaatgattggcgtcgatccggttgtgtagactaatttgtcataagtatcggtagtaacggttccggtttttagatccttgacttcaactgttttagttgctggatcaatattgagcacatcatgttccatttgcatattagcaccgagtttagcgagtgcttcgggactggaatagaacattttatccgggtcactgacatgatcaccaacccacaaggcaatgccgcacgagaggaaggacaggttgttattgcgttcgtagacagtaacctctgcatctggatggtcggttaggatctgctgggttgcaaatgtaccggcatgggtagcaccaatgacaagaatcttcatatcgcaatcgctcctttaaactattgataaaaatttcacaaacgaattataacataattgattgtgtcatgctatattgcttgcgatttattttgtgaagaaaaagttaagaagcgctttcacgatattgtggtctgctgagtatcagtggtgtttagatgctgagatgccaagttggcgcatgatggttggagcgcaatctttcgacttgtagtcccgtactgggatatatcaaataggagttgaggattccagccacctgccaatcatttccaaatgatgcatcaattgaaatctacgcacaactcccaaccccggaaaatgatgctgcgcggccgctgccatcaaagctttcgttccgagcgtctgtgcatcgggatggtgtggtaaccacgcagccagctgcaccagaatttcaaaaaatttggcttgcgggttggtgaagtcgtcattgttgactgaaacaaaatgatgcagacgcagggaaccatcagctgccgggtaaacaaggtggatggctaaggcgcgctgcggatagccatgctcgaaataatcagcagtggcgagcgggtaatccgcaaagccgatgcctggcaacatcaacggcgggtattggtaaaattcatcttgcagcagcccgtaatcagatgtgtgtggataaacggtgaagtgatcatttaaataaaccgcgtgtggcaaagctaactggcgcacccgagcttcatcaggcaccaaggccagctggcggcgcggcaataatttggcttgggcggctgtggtcgcaataatcaaaggcgctggttgggcatcaaaaatccgcgcctgctgaacggtcccactgacgtccggtaaatgacgcggggttgccaatagacgatacgtcccgacttgcgggttttgaatcacataagcggcgtgctgggctcggctaaaggcacgggtagctttggtaatgccggggatgtcttttaccggctcaagaattggcgtgaccgtggtgggcaggtgctggcgggtgagcaattccgtgatggccgctaagtcgaattgtttgccgcggataattggaaaatagttcatgataacctagccatttttaaagttgcgagttcagccgtcaatgcatcgatttcttcttggagcgccgcgatcgttgtgttgttgagttcatcgacaaactggtcataaagatttttgtcgggatgataaatgtcataatctgccgttcgtttgcgcagttcggtgaacaagtccgcggttgaaaattgcccgagtcccttggcaacctgctttgctttgacgacttcacggttgagactggcaatgaagcggtcggtgagctgatcttctggtacttgcagagtttggcggcgcgcaggtttggcaatcgtcaacgttcccggcgtcaccaccggcacggcactggctttgatggcggcttttgaaaatggctggtagaccaacacgccaatcccagccgaaatttcggccgccactgctttgtaaagccgttgggtcaaaacaaaatagttataatggccgacaaaactcaattgggcatgactatgaaaatctgctttagtgacttttaattcaaaacaccgccaaatcgtttcggactgctgtttttgccgcacgagggtatcgacaataccgaagtcgtccggcatcgtgacttcttcgactgcagtagcgccttgtgcttgccaataagcgtaaagtgtcgtttctaagtcacgcgtgagttgggttttcatgatgggcctcccaaaagtgtgtcagtaattgtgctaattgcgtgggattgtagctaacctgggcgtgggtccagtgatcaggaaacagacgggcataacgcggggtgataaagcgttcatcaatgagcaggattacgccgacatctttggccccgcgaatcacccggccacctgcctgcaagacattgttaaagcctggcagctggtacgcgtaggcaaagccctgaccagcatcgtgatcaaaatatgctcgcaactgatcggtttccggattgatgcccggtaagcccactgacacaatcgccaccccaatcaattgcgtccctttgaggtcaatcccttcagcaaaaatgccgccaagcacagcaaaaccaatcaccggctcactgccagccttaaagtgatcaagaaatgcttgccgctcactttcattcatggcattttcctgaacacaggttttaagatcgggatttgccgcagtaaacgcctcgtgagccattttcagataggcataagatgggaaaaagaaaagataatgcccggctttagccctgaccagcgtggtgagacttgcgatcagctgcggtaaatcctgcgtgcggcggcggtacgtggtgtggacactcgcatcgacaatgatggcctgattgtccggcgtaaacggtgatggcaaggtgtaagcaaggctatgttcagcgcctcccagtaacttttgaaaatacggcatcggtgataaggttgccgaaaataaaaccgcgcctcggccctttttcaaggcatcatcgacaaaatgggacgggtccagacagagcattttaatcataatcgtgtcatgttccttggcaatctcggttttgaaggtatcgtcataaaaatcaccaatacgtaaatactgattagcgagaaaaaacactggtaaaacaagttcgacagcaggctgcagcgcgggggtgggcggttctgccagccagtcgtgaaccgtttcggtaaaccgggtcaacacctgcgctagatcatcgagcggtgctgcttgaaagatcagtgactgcccgttgagtagctgatcagcaagggtattcatcgtggtgacaattcgcgtcatcgtccggcgtaccttggttaatgcggttcctttgaacggggcgagggcttgtttgaggttgataaagtcctgattggtcaggcttgcggtatacatatcgcgcgcccggctgacaagattatgcgcttcatcaaccaggaaaaactgactgtcatcggcttcactgaagaatcgctgcaaaaaaaccaagggattgaataaatagttgtaatcacaaatcaccacatcacaaaacaaactggcatctagcgaaaattcaaatggatccagtgtgtgtttgcgagcataggattcaatcacagatcgggtgagttgatcttcatattccaaaagatcatgcagtgcgggtttcaggcgatcataatagccaagcatatagggattttgactagggtcatcgggctcatcggcgaaggtaatcgtgtctttagctgttaaggtgatgctttttgccctaagtccgacgtctgccatcagcgctattgcctgttccgccacccgacgtgtactttgcttggctgtcagataaaaagcgcgctgaatcaacccactacccatagccttaatggtcgggaaaagcgttgaaatggttttgccagtaccggtgggcgcctgcacaaacaaacgcgcgcgactgtatatggctttgtaaacagcggcagcgaactcgtgttggccagtacggtactgcggaaacggaaatttgagtgtggcgatagaagcatttcgctgtttaataatatcgctgcgcagttttaaccaggcagtgaattcgtcaagtagatcggtgaaatcatcagctaactcggcggcactttttgtttcagtgaagcggctgactgtgtcggtactggtttgaacataaaccaaggtgataacagcatggtcttgatgccgctgttggcaaagtaggtggccataaatccgtgcctgcgcccagtagcgatccttcgtgttttgcgaacattcttcccatgaacgggcactggttttaatttcttcaacggttagcgtcttgttttcggtccaaaccccatcggcacggccttccagttgataatcctcgtcattgacggtaacggtggtttttaaatagacttctttttcataatccgattcccgatgcgctgcttgaagcttgcggtgaatctggctgccgatcatggcggtgttatttgagttactggtaaccggatttagatcaccggtacgaacggttaactcgacaaattcgcgaatcccgatacggttatgagccatcagcgcacctccttgtgtgagtatgattagcttttagtatagaacatacattctgtttggggaaattgtgggtgggattccggttgtttctttgcttttaatagaattagaggcataataggggtgtcaagacatatgacaaatacggcggcttgcaaacactgtcgatcggtaagccgcgacatcaaatgagggacatatgatgaaaaagacaagtttctggcgtttgttagggtttatgggcgcgattttattgttattgaccgcctgtggtaagcaaggttctgcggcaaagtcgtcgtccagtgcaccggttaaaattacatactggcatcggatgaccgggacttatgaaaagtcgctgaataagttgattaccaaattcaacaatagccaaaagaagtacaaggtggtcgcgacctctcagggttcatacaacgccttgcaacaaaagatcatggcggcagggaaatccaagacgctgccaaccatggcccagtcaccgtatacaaatatcggtgactatgtgaagaatcagttgttgttgccatttgattcggaaatgttaaatggttcgaataaattaagcaatcgtcaattgaaagatacttacccaagctttttagcggcgggcaaatacgacggtaagtactatggcttgccattttcagtttccacttcggtactcttttataacaagaagttgatgtcacagtataacatcagtatgccaaagacctgggctgattttgcggcggatcaggataagctaaaagggaccgatattaacgccatcgagctggatcagagttatgatgtggccttggaagggatggcttatggtgctggcagtcagctgattacgccgaagttgaaggccaacttgaatgcaccgaagacattagccgcggtgaatcagatccttgatttgcgcaagagtggtgccttgaagaccgccggcgaagaccaatacttcagtgtgccgtttgcaaatggcaaggccgtttttgggattggttcctctgctacggttccggtgttgcttcaacaggcacccaagagtcttgattggggtaccgcggtcattccggaatacgaaggcaagcgcagcaacccgctcaacgggaattataatgtgcttttcaaaggcgcttctaaagcgcaacaagccggcgcctgggccttccagaagttcttgctgaagtcggaaaatgccgcacagtgggccaaagcttccggttacgtgccagtgactaagagtgcgtctaacagtgccaccttcaaagcctatctggaaaagaacacgcaatacaaagcagcagtttcagcagtctcgcaaagttttgcctccactgtttttgccggttacaccgactatcgcaacgatttgatgagtaccgttgacagtaccttgaccaagaatgtcagtggcgaaaccgcctttgataatctacaaaagcagaccgacaaaattttagaagaaaataaatagttttttaatcagccagtaataccgcgatgtgttactggctttttgctgccatgtcggtaaacaaccgtctgtcgctgccgatgtcatgatgcggacatggcgcaaaacagtttacgtcattgaggtcggatttgcgccgtattaccttagtgggctatgatggtcaaagcattgttatgcattaaaggagaccgatatggaaatcaatgtacacaaatttcaggaagctattttggccggcactttcgaacacacagcagttcacgtcactgctgcggcattcaagaaagacggcatcactgacgcactgacaaaggtttttgcagatgtccgcgcggcgattgagaaggatcaattgattcaggcggatttggtggttgatttccctgaaccgacaaccattaccgttgagaccgggatcatcaacctgccatttgcgaatgttaataaaatccctaattttctggaaccggatgaaattgttccggtacgggtttatttaattgtggcatcaccttttgtcaacgtatcaggtttgcgcattgatgaagccgcgactgccgctgattatttgcaggattttgacacgatcaatgcccaaatgacggcctcagttcaggaaaagcttgaacacattcaaaccgaaatggccaagccaaaagaaaccgttaaagaagtgcccgccaataagcaaaagaccacggctaaaaaaaccacgcggcgagcgacgaccaagaagaaaacgaccacgcggaaaacaaccaagaagtcgactagtgcacgtaaggcggcgcccaaacgtacgacgactaaaaaaacgatgacacgtaaaactactaaaaaatagccttttagcgactagtgatcattaatttgatggctagtttttcttcctcagcgtaaggtaaggatacactttttaaaataggtttaagcccgctgttctggctgggggcctttttgcgtacgcaccaacagagacttacagctgctaaataatgcaaaacagcccgctgcgcatcttttgcgtaacgggctgtcgattttcccaacgccatcgttcattatggcgttgaatcgcaacagcgcgcgatctcagtgggcatcttttactatttttaactgttgttacatttagttaagagaacgaatgattggcctagggtgatcgtgtataatgaaaggcgaaaccggaaaaagtgcttacagatagtcatgatgactggaaaacgcgattgaagaggagtggagcttttgacagaaccattgtttttgaagccatattttaatcccaagatctggggtggccgtaaacttaagactgaatacgggtttgatattccggacggcaaaatcggtgaagcgtggattatttccggacatccgcatggaccggcaaccatcgaaaatggcccactcaaaggcaaaaccttgcgtcaagcctggcacgaagatccggcttactttggcccgcaacatagccaggaatttccgctgctggtgaaaatcctcgatgctgaagccagtttgagtgttcaggtgcacccagacgatgcatatgcagccgcgcacgaagccaagggcgaacttggtaaaactgaatgctggtatattttgaaagcggatccgggcgcctacttaatttatggccaccacgccaaaacacatgaacagctcaaggaaatgatcgaagctggcgattgggagcatctgttacgcaaatatccggtcaaaaccggcgacttcgtttatgtgccaagcgggacgattcacgcacttaacaagggcattgtcgcattggaaacgcagcagagttctgacacgacttatcggttgtacgactatgatcggacggatgatcaagggcacaagcgcgagttgcatattaagcaaagtcttgatgtgaccaccgtgccattccatgatcctaagttgcacattaccaaagaaaatgtcacaggtggccaaatcactacatttgtgaaaccaccattatcaccgcattttgccgtctatcggctcgatgttgacggcactatgtcatttacccagcaggcaccttataccaacgtgacggtacttgacggcaccggtacctttacggcagatggcaaagattatccaattaaaaccggcgatagtttcttgattcccaatcaaattaaaacctggcagtttaccggtaaacttgccatcgttacctcaacgccaggtgccgatgcgtaacagttgagtttctggtttcagacaggttaaccattcaaacagccttggagacgaaaaatctctgaggctgtttttgactgttcagacattgcattttcactgaaaagtaatttttagatcatgaagacagtctttaggaagacggcaaaaaattaataaaccatgagagtgctttcttattgattattttatattaaaacgttggtctaaggtggtttagcaaggctacttgactcatatgcgacggattgaaaagcatctagcgtgactggtatggactagggcaaaaccgcagtgcgaagccgccaaattagaattaagtcgtttccattgacaatcagagctgcaaacgcatacactacatgtggttggtaccacgtggaggtgaggatatggaaaaggttccgttgaccaaacagctggtagatcagttggagacattcatcaaagaaaaacttcagcctaatgacaagttgccgtccgagcgggatctgagtgaactgtatcatgtcagccgcaatacggttcggtccgcgttgaatgagttatttctgcgcgggttcatttatcgcagtaccggcaaaggcacgtttgtcgctgaacggtttgacgaacgaacggatgtaagcggatcgtacagttttaccaaacaaatgctagccatgaatcgtcagccagtaacgaagattcaacgactggaaaaaatcgcggtaccgcctgacattgccaaacggatgcgggttgatccagagacaccggtttatgttcttgaccggttgcgaattgcggatcagttgccgatgatgattgagcgtagttacttaccggcgttgacggtgccggatctgcaagcatctgatttagccaaaaatccactatacgattggctggaacagcattatggcattcacattgcgtcggttgatgaagctttttttgccgggctggtctcgccggaggatgccaaacagctgcgagttgcgccggcatcggcatgcttaaacattcggcgaacgacttttgccgatactggggaaatcgttgaatatacgttgagtgtggcgcgcgcggatcaatttgtttatcacgttcatcatgtgaatcactagggaggatattattttgttcgaaaaaacgacagaagaattaacgaaaatgggtgctcagattaccacggctgagatcaagcagcagccggaactgtggcaagaagcgtttgctaattatacgcgtgacaaggaaaagattacggctttcttgaagcaggtaaccgctgctgcaaatggtcagaccgtccgggttattttcaccggtgccggcagttctcaatatgtgggtgataccgttacaccgtacttacgggcgcatggtgatcgcagcaagtttgaatttgaatccattgcttccaccgatatcgtttctgcaccttatgactttttggaagccgataccccgacgattctggtttcgtttgctcggagcgggaactccccggaaagcctgaagaccgttgagctcgcggaacaagttgtgcataatctccatcagatcagcattacctgtgctcctgaaggccaattggcaaagaaatccgctactgaagataagaccttgttgctgttgcagccagcaggttctaacgataaaggctttgccatgaccggcagtttctcatgcatgacattgagtgctttgcttgtttttgacgctgccagtgatgatgacaagcgtcaatgggttcaggcaatcgccgcgatggggaaagaagtcgtagcgcgtgaagctgaaattcaagcggtattggatcaagactttgaacggatcgtctatcttggctccggcagtctcggcgggttgacgcgtgaaactcggttgaaggtacttgaactcaccgcgggccaatacgcaacgatgtttgacacctccatgggcttccgtcacggaccaaagagcttcgttaatgacaagacactgttgttcgacttggttagcaacaatgcttatacccgccaatatgacatcgacgtgcttgaagaagtcaaagacgacaagattgccccttctgtcatggcagtcggcaccaagcaggatcagaacttctcgggtgacggtttctactttgaaaatggccttaaggatcttccggaaggctaccaagcattgcctgatgttatgtttgcccagactgtggcacttttggcttccatcaaggttggcaacttacctgataccccatcaccgaccggcaccgttaatcgcgtggtaaaaggggttatcctccacgactattcaggtcaggaataaggttgcaactgtcatggcgccatttagtcgagtaaatcggttggatggcgttgctaaaactgggaggcaagtgttcatgagttattacattcacgccgcaaaattctttctcaaacatgtgactgaaattggcgggtatctagaagtgaccgatgatggccagtttggtcaatatttacctgaaagtgccaaaccagaaggcgaaattgtggaacaaccaggcaagctaattgcgcccgggttggttgacacccacattcatggccttttgggacacgatgtcatggataacgattgggacggcatcaataccatgagccagaatttgctcaaggcaggcgttacaagctggctacccaccactttgaccgggtccttcgatcagctaaacgatgtctgcaaaaccatcgcggctcatgcaggcgaagaatccggcgccaagattcaaggcatttattttgaaggcccatacttcacaaccaaacacaaaggcgcacaaaacccgaagtatttcaaaaatccgagtgaaaaggaatacgatgcgtggcaaacttcggccaatggtttattgaaaaaaatcgccattgcgccggaacgtgacggcgcagttgcgtttacgcggtatgcgaccggagatggaacagttgtggcgctgggtcatagtgatgccacctttgaacaggcaaaagcttgtgtcgaagcaggtgccactgtcttcacgcatacctttaacgggatgagcccactgagtcatcgggcacccgggatggtaggcgctgcaatgtacctacaaggcgttgatgacgagctgatttgtgacggtcatcatgtgcggcccgaagttgcgaccacgttaattcggctaaaaggcgcagagcacattgctttgatcaccgattgcatgcgcgccggaatgatgcctgatggtgattatgtactgggcgaattcccggtttacgtcaaggacggcatggcgcggttaaaagatggcgacagtttggccggttcggtgttggaactaaaagattccttgacgaatctcttagcttggaacgcagccacgccggaagccattatccgcatggcaacccaaactccggctgcttcctgcaagattgacgatcaatgtgggagcattttaccgggtcgagctgctgactatctggttttggatgctgacttgaagctgcaggcaacctatctcggtggaaaacttgcgtatcaagcagaagcatgacagctttcctgacacaaaaccttgtgaaaaatggcgttaatgtgtgacactggattatggcaacggaacgggtgttatgaatcgttttgggttgccatatgcgcgccgggtcacgctcaccataacgcgttcaccggcgcagaagtctgcgtgtaaggaccttagccgcaatggccaaagcccggccgtcacgtctaaggccacttacactccgacttctgagcgcgccggatcacgctcacactttggaagggaggttaaggttcgtgacgaccttttcgatcgatcatgaatttatgttggatgggaagccgttcaagatcctatctggtgccattcattattttcgggtgcatccgagtgactggtatcacagcctgtataaccttaaagctttagggtttaacacggtggaaacctatgtgccgtggaacttgcatgagtatcgtgaaggcgagtttgattttagcggcatcctcgatattgaacgttttctcaaaactgctgaagatctcggcttgtatgcgattgtgcggccgtctccttatatctgtgcagagtgggagtttggcggatttccggcatggctgttgacgaagaagatgcgtctgcgtactgatgatccagcttatttggcggcaattgaccgttactataccgcattgatgccgcatctagttgatcatcaagttacccacggcggcaatgtgatcatgatgcaggtggaaaacgagtacggttcttatggtgaggatcaggattacttggcggcggttgcgaaactgatgcagcaacacggagttgatgtgccgttgttcacttcagatggaccgtggccagccaccttaaacgccgggagtatgattgatgccggcattctggcaacgggcaacttcggctcggctgccgataagaatttcgatcggttagccgcttttcatcaggaacacggtcgcgactggccactgatgtgcgtggaattctgggatggttggtttaaccgctggggtgagccgattatccgccgcgatcctgatgaaaccgcggaagatctgcgcgccgtcatcaagcgtggcagtgtgaatctctacatgtttcatggtggtacaaattttggcttcatgaacgggacgtctgcgcgtaaagaccatgacctgcctcaggtaacatcttacgattacgatgccccgctaaatgaacaaggtaatccaacgccaaagtactttgccattcaaaaaatgatccatgaagagcttccagaagttcagcaagccaagccgctggtcaaacccacgatggcgccagcttcacacccgttaacggctaaagtttccttgttcgcagtcttggatcagttaaccaaaccgatcgccgcttcttatccgcagacgcaagaatttctgggccaatataccggctataccttgtatcgtacgcagccgctcattagtggcactgacaaaggaacaccggccaagttgcgggtgatcgatgcccgtgatcgggtgcaagcttatttggatcaaaaatggctagcaacccaataccaagaagcaattggtgatgatatcttgttgccggaagttgagggacatcatcaacttgatttactggtagaaaacatgagtcgggtgaattacggatccaagattgaggcgatcacgcagttcaaagggattcgcaccggtgtcatggttgatctgcacttcatcaagggctatcagcaatacccgctggacttgaatcgcgcttctcggcttacctttacggaaggctggcagcccgcgacccctgcgttttacaagtacacgtttgatttgaccgccccgcaagatacctatcttgattgtcgtggattcggtaaaggagtgatgctggttaatggtgtaaatgtcggcaggttttgggagaaaggccccacgttgtcactttatgtaccggcaggactcctgcacgccggaaaaaatgacgtcattgtgtttgaaaccgaaggccgctacgccgaaagcttgaagatggctgaccacccgatatttaaagaaccatgatggataacttccggtgcaagctccaaaccgcaccggctcacgctcacagacacagaaggaggagtagaaaatggctattattgctgcacggattgatggtcgcttggttcatggccaggttgccaatctttggaccaccaaactgggtgcgactcgaattatggttgttgatgaggcagcatccaagagcgacattgataaaagcgggttgcggatggcgactccggaaacggtacgcttatcggttctggatgtcgcaactgccgcaaaccatattttgaaccacaagtatgattcccaaaaggtgttcattgtcgcaaaacgtccagaaacattccttgctttagtcgaggcaggtgtaccgattaaggaattgaatgttggcaatatgtcccagacagataaaacccgttccattacaaaatcgatcaatgtggtcgatgaagatattgaaacgttcaagaaactggacgctcacggtgttcacttgattgcacaaatggttccgggtgatgctgcagctgactttatgtcattgctcaaaaaaggatagggggagtcaacaatgattgcatggtagcaaatagtgattataacattatacgcaggttatcaaattcttgatgaactgcaaatttattcagccatgagttcatcagttttcgctggcttggttgccggtctcgttatgggtgacatgaaggccggcttgctaatgcatccacccagttgatggttctaggggttggtactttcgggggtgcttctaaaatcgatgcaaactccggtaccttgttagcaactgctttctctgttagttccggtatgaagccggaagctgctgttgctgcgattgcggtaccagttgctagtatcatgattcaaactgatattcttgctcgttttgcgaatactttctttgcacatcggattgataaaatggttgacgagtataattacaaaggcatcgaacgttacttccttgccggagcacttccttgggctttgtcacggatgattccagttgggttggcgttggcctttggtggcggttttgttaccaatattgcccacgcattgaacaccgattggaaatggttaggcgatggcttggcaacagccggtgcggttctgccagctgtcgggttcgcaatcctgctccactacctgcctgttaagaagcattttgcttatctgatcttaggctttatcttcaccatgttgttcaccaccttgtttggcaatattcagacattgggaacggcagtcgctggtgtggctaagaactttacagcgacattcaacggcttgtccatgctcgcaattgcattgattggatttgcgtttgcagcgatcagctaccagcagtcaacacaactgcatgacagtgtcggtggcggttcagaagccaatggtggtgctaaagcagcaaagaagactaatgatgagggggaaatcaccgatgatgaactctaataaacccgcttacaaattaactgacaaagattttcggcagattaaccgtcgtagcttgttcggcttccagttgggttggaactacgaacggatgcaggcttcaggttatctgtacacgatcctgccgcagttgcgtaagatttatggtgacgggacgccggaactcaagaaaatgatgaagactcatacgcagttcttcaacacctctaacttcttcaacaccattatcaccgggattgacttggcggttgaagaaaaagaaggaattgccggtgaagaaaccgttgttggtatgaaaaccggtctgatgggctcctttgcttccattggtgattcaatctttgctgctttgattccggctattttcggggcaattgctgcgaacatggcggaaaaagggaacccagtcggtatcttcatttggattgcagcccaagttgccgttatggtcttccggtggaaacaattacggattgcctataacgaaggggtttcgttggtcacaaccatgtcgcatcggttggcagctttgaccaatgccgcaacgatcatgggggtcttcatggttggcgcgttggttgcaaccatgattaatgtgaaatttgcatttgcaccaaagatcggcagtgtgccactgaacttccaaaacagtgctgacatgatcattccaaagctactcccggctttgatcgttggtgccgtttattggttgcttggccgtaagcatatgacgtcaacccgggccatcttcattgtgttgattgtgtccgtggccttgtccgcacttggcgttattacaaaaggctaataaataacctgccgaaatgtttagcacgaagcatgagccaatccagccatgttcggcgtgtgagcatcaaatggttacgcggtttcgtcacaatgaagtgcaaagcgttggatcagcgcatgttaaaggagttttggaaatatgagtaagttagttttgattagtcacggtcaattatgcgaggaactcaagaagagtgccgaaatgatcatgggtccacaagatgacattgccacggtagcattgttaccgaatgaaggcccggaagattttcaagccaagttcaaagcggcaatcgaaggtgaagatgatgtcaccgtcctagccgatttgaaaggcggcacacctaataatgtggcagcacgggtgttggcagaaggcggcaaatttgatctctatgcaggcatgaacctgcccatggtgatcagtttcctcaacgcccagatgctggacatgaagccggatcttctaggagacggcaaggccggtgtggtttatattaatgatattgtgaagcattaatttggttcacaaattggaaagtctgtgtccgttgggatgcaggcttttttggtactgctaaaaatgcttacgagtgccgcgctgggaacaccccgattcgagctaagagggctgaatcgtaacctgattaaagtagatttgaaattgtgctgggtcgacaaagccggttgtggcttgcatggtgtttaacattccggtggtcatagctgttttcagaatggtctgatcagactgcttgtcgtggatacccatggcaagcccagccaaggttgcatcgcctgaaccaactgcattgaccaccttgatcttggggataacggcatgatagaagttctgcccatgctttgcaaaagcgcctgcagcccctaatgaaactaccacccaatcgacaccagcaaagacaggcgcctgtaggtcttgtttgagtgttgaaagatcatttttgtcaacatggtgtttaagcaaatcgctcaattcctcatcgtttggtttgattaggaaaggcttaagtggcgcatcaagtgcatgcgtcaaggtggcacctgatgtatcaagtaaaactttgacaccttgtttttcagcatgagcgatcatcaatgtgtagtaggtctcgggcaatccttgtggcatagaaccagagatagtgactagatcggcttctggcagcaagtgatcaaaatgatctaggaatttattagcgtcttttctatcgatcgttggtcctgcttcgagaatttcggtttgattcccgttatcatgtaaaatggcaattgagctacgtgtttctgcctgaatagacaggaattggtgagggatgccctcgttatcgagctgatgctgtagccactggccaaaataaccaccgatgaatccagtggcaaggatatcgtgatccatttgatgaatcacccgcgaaacattgagacccttgccaccagctgttttgcgcacatttttaactcgattaacagtattggtggctaaatgctctaaagggtatgaaacatcaattgagggatttaaagtaactgtcaaaatcataatcttggcctccatgacaaaagtcgattcgatgaagaatcgacttttaattgcttgaatccaaacaggtgagcttgaaaattttaatgacgtttggattgcttgtcgaacgattaaagccattttttgtaggtggcttttacagacataagatttgaaacattgaatatctttgcgacattatggttaccgaaccttgtgtaacaatagtgaattagccgcgggactttccgcctgaaacattgactgtttggccagtcatgtaacttgagcgatcagagaggaagtaggtaactaaatcagcaacttcggaaagtttaccgctgcggcctagaggaattgtcgaagtctttgcataacctgctcgtagctgttcgaccgtctcatgacgtgagtaagcaagtccttcttcgtaagaaagcgtacgtagaccggtggcttccagaacaccaggcgcaacaccgatcatgcgaacattgtattgacccaactctttagcccaagcgcgagtaaaaccattaattgcgccttttgtgccagaataaatgccggcaccttgtgagccttcgagtccggactcagatgacatgttaacaatgacacccttatgttgcttaacgagttccttgaccacgatggaagagcaaagccaaacgcttttaacattgatggtaaacattttgtcgaagttggcttcattgatcacatatttgccatcaggatcagttggatctgttaaaatacgagggatgttgatgccggcattattgaccaaaccgttaatggtgccaaacttttctttagcagtcgccaccatgtgctcaacttgatctcgtttggtaacatcggtctgtacaaacaagagattgtcatctttgaatgagccttccttgagatcagcgttgacaacttttgcatggttaccaatcagatctttaacgatggcgtcaccgattcctgaagagccgcctgtcacaataaatacccgatcatcaatgtttaaccaatctttagccataagttgattcctcctaaaatttaatttgttatttagtgaagcaataacctgagtttatttcgtcttgttatccgtgacatataagcgttgccgcttgtatgcaatatacgtataagcaaatgcactgataaacaagatagcgataacgataaagccgatgccaacctggccggtaaagcccttagttaagaggtacgtgattggtgagcctgcttggtcaagtgaagaaacttctttacccttagcaagtaaattcgtcgcatggccaagggcaacctctagcggatacatttggtttgaaatccagatagtgatgaacataatgaccgaaccagagatgagtgttcggaagatgtttcctttatgaacccctgttgcaatggcgataaagaacccgatcgtggctaaatcaccgaaaggcaacactttgttaccaggtacaaggatcgcaatcagcaaggtgatgggaacaaacagcagacctgcagcaataacgtctgaattaccaagtaacaaagccggatccatccctatcgtgaacaagccacctttaaagtgtttgtccatgatgactttggcaccttgtgaaattggaatgagtccctccataatgaatttaacgaccacaggcattaacaccataactgcggccatttgtattcccaactgcagcgatttaccgattggaaactttgccagcaagccgataatgatccctaatatagcgccaataatggatggctgacctaagacaccgaacttttcttcgacggttttggatgtgattgtaattttgttcagtcccggaatcgcttcaatcagatcatcaattggcttggcgaaaatacccatataagcagatgtcccgtgtggaattgagatgccttccaagccaaaaaagttatctgtaacaggtttgaaaatatcgccaagtttgtaagcgattgctgcatgaacgcaaatggcaacaattccccaagtaaaactacccgtagcaagttgaacaattgcaccagtaaacgccatgtgccaaatgttccagatatccacattgacaacttttgtcatacgcgtaagcaacataatgacattaacggcaatggcaattggaatggcgataagacccatggctgatgcccatgccataggagaagttcctggccatccgacatcgacaacgctaagtcctaaattaaaattcttggccattgcctcggcagccttacccagattatcagttaacaacgagatgactaagttaataccaacaaatccgataccgattgaaatacctgcgcgaagggatcttccaacgccttgtcgcagaaaaataccaagtataaagatgatgattggaatcatgacacttggtcccaaatcaacgatgtattggataacttgcatgctgctacctccttttatatagaaagacaacccaaaaaattgcgataaagatgaatgctagataaaacggtgaagcatatacaagactaacaacgagtttgatgattaatgaaagcccttacacgaatgatgataaacgctttttttaaaattgcaagtcttttgtttaaattattttggtatatacccaagaaaaagcgcttaaatagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaaataaacatatgcaaagaaaatataatattagggaaagcgcttgcattaatttgaattagcgactatgatgactcttgaaaacaactgatggatggagagtgattagaatgacattgttaaacaagcacttgattcatcgcaatgtgacttttagggatgccgatgacgccctgaagtcaatggcgaccgcgatggttgagaatcaatatgtgaaaccgacattcgttgatgctgttatacgccgtgaacataaatttccgactggcttgccaactggaggtattatggttgcaattccgcatgccgattggaccaatgttaatcgcgggacaatttcggttgcaacgttggagaaaccagttctttttaagaacatgggcaatcctgaagaagatttagcagttcgattaatttttatgttggccgtcagtgaaccacatgcagaggttaacttgctgagagacttgatgggaattgtgcaaaatcaagcaacactacaaggactgttagatgcgcccacagatcttgatctgtttaagcgcttagaggatatgtttcaagatattgttgtggataaagagaaaaaagaggagacctcaaaatgaaaaagattatcgttgcgtgtggctcaggaattgcaacttcaactgttgcgcggaatgcgcttgaggaaaaactcaaagctaaaggaattgatatgacacaagtatcgatggaccaaacttcaattccgcaactacgctctaaggccgatcaatttgatttggcggtgacgaccggtaagtttacagaagatatcggcgttccggttttaaacgggctgccatttcttactggcgttggcgaagacgaattagttcaaaaagtcattgatgtgcttggattggagtcgcgaaagtagccaattgatccggaaatgacggttcgcaaatcggagttaatagcttgaattgccgcataaacatggtatgatcaaaatgactcgttttattaaatgggtatgaattaacgtatggtcaatatacgtttagtggcctgatgagtttaaaaaataaaaaagagggatagccctctttttttattgaaaatattaactcgtgatcgtttacttagagtgggaggtgtttatggttgaaacattttagtgtaacgctcacgtctgctgaagccacacatatcagccgtgacaacttttatgagccgctcgacttgacgatcagaaaacaactattatttaactacgctttaaagaatcggcgttggattaaagtaaacggttttttgcgtcggccaggtgattggattaacgaaaaagaagcatttgaggtcactagtctggcatcccgattaccacttgaacagcttcggcgccgatatccggattattatccggtaattaataaatctcaatggcttcgacaacgagatgaggcccaagcgctttttgatacatttattccaaaagtacagcgtcgaaaacgcgcacgttatgataacgaagtagcggcattttgtcatgacaatggttttcaagagattgattcgttacggacgcgtgaagctagaagtccaggcgcgtatgtcgtcgcactggacgattatttgtcgatttatttcggcatcgtacccaacattgctgcttcaatcctagctcactgggatgcattacttgatttgaacgcgataacgacgcttgatgctttgccaattgatgcatttaagccgcttgatacaacccgtatttttattaaaaccgccgaaaagcgtcatcttgaagagctcaaacttgaattagctgatctggttccttatcgatatacgcttaatcaatcttctccctcgttggcaggcatgggatcaacgaaggagacaaacttagcgctctttccaaaaggcgtcgaggtccatgatgcgatgggcgggtatgaattatttgaatacgatctggctcgagagttaaacattcatccgcataaagatgatgagcagtgaccggccagcaaaatccccccacaattaatggcgttattgtggggggatttgtgttgagagaagcaaaaattgaaggggtaaatttattaacaggccgcttgtcacaattttatacagaaagaaataaacttgtgagggaacatgcgattgtcctgttttagcatctcacaattatttactttgcatcctagagggccagtagatgactgagacgagatcggtacaattcatgttataacatagagtaggacatggattgattaagacacgtcaagttaacgctaagatacctttgtgtaaccatgacctttacaatattaaaactaaaaatggtttctgctaactgacagatgagaatggaggtccctcattgaattattttgtgaatgaaaacatattttcaatgaactcaggtacggaattttccgcggcacaacgggtaatgctgttcaaaaagaataaagtgccggcgcagatagtcacgcgtaattacaatccattgatgattgatgatgttcaccgaattgggttagagcaaaaagatgttgtcaatatgtatgactattttcaggagatacttgatgtcgcgcctaaagatgttaatgttcgctatactgaagctattgataagtatcaatatcacattgatggcgtggatccaaatgaatctaaaattgtttatcatggtaaaacgatcggtaaagtcaacattgcgccaggtacagtcgggcttgtggggtcgattgaatactacaatgatatgaatacggttgtcgctaaagacatttgggatcgccgcgggtttaaatcgtcaacccagtattttcatcctgatggtgcgtttggcccacaggttttttacgatcgtgatggtaagcccaagattgaaattacgcggatgaatgtgaatggcgaattgcgcaacaccatgtacaagctgcttgactatcaaggccgggcatggcgctttgataccgaaaatgaaatgtttgttttcttcatgaatgaactgatgcttaaacattctggcgtcttaattaatgatcggccttcattgattagtgaagttgccgcagttgttggcgcacgtggtaagtggcagtttcttcacagtgcccatacttacaagccagaacaagcaggtggatcgcgtaactatgtcgactatctccaaccactatttgccacgcacatgaatgactttgatggcgtcatggtcccaactgtggagcaaaagcaagaaatcgataagttcttccactttaagcatgtcgtggtggtgccggattcatatgctgaaccgcataaactggtccctgctgaaaaacgtgatcgcaataagattgtttatttgggccgaatttcaccggaaaaagaaccacaagaagccgttaagatttttgcaaaagcgaaaaaagacttaccagacttacatcttgagttttacggttactcatctgatcagtcgcttgataattcactaaaagaactgattaaaaaactggaaattgaagacgccgttcactttaatggctaccaaaacaatgaccagttggcaaaaaagcttggagacgccgcggcagtattaagtacctcttcttcagaagcgttcggcatgaatgtgttgcaggcgatgagttttggcgtgccggtgatcggctatcaagttaaatatggcatgaagttggtggttaaagaaggcatcagcggatacttagtgccaaatggtgaaagccaacaaggtgccaaggcgttggttaagttgttgaccgacaaagataagtgggccgatatgcttgaatcaacctatgaatcatcgcagaagtttaacgctgcggcagcttggcaacagtggcaggctcaacaagcagctgttcctaacgtattctcaaagtaggggagagcttagcatatgatattctttattaattcaaattttaataaaaataattccgggattgaacacgctcaattgaagcgggcaggactctttcgtgatcatcatgtgcctttcaagatgatttttcgcgaatggaatcctcgcttacatgaatacttaaaccataatggggtcagtgatgacgaggctttgaacatgtttgactactaccagaatgccgaacaggttccagctaaaattcttcacgctgaagacattgattttggattcgacaagcttagttacgccaaagagccagataaccaccgctatttggtgacccgaggcaaactttttgtcggccggatcaattactttgaggatgactcggctgaacgcgtcagctcagttgaacaattcgatggttttggaaatttgtatcgggttgacttttatgacttccgcggctttttgtcgctgtcgcagtggtatacgccggataataaggtggggactgaggtttggcataaagttgatgggcggccagttattgagacttttaataaatatgacgccaatcatgcgttcattaagaccggatggcggttgattgaagacaacggtgcggtttatatgttttcgaatatagatgatttgacgcagcatttttacaataatgtgaatgagcaatactggaatgacaaagaagtcaatgtctttattcttgatcggtcacatttgggcgattggcaactcattcacttgcagcggcctgcttatattgtcatgaatttacacaactcacatgcaggcgatgcccaagatccgatgcactcggtcatgaataatttttatgagtacagcttgattcatgctaatgattacgatgcgattgtttcagctaccaataagcaaactcatgatgtgcgcgagcgattccacccaacgtgcaagttgtttaccattccagttggcgttttgccagatgaacagttggctcgaccgcatgttgccatgaccgatcgccagccggcaaaagttctggttacggcgcgggttgcccctgaaaaacaaattgatcacattgttgcagcgattgggattgctaagaaagatgtccctaacatttctttggacgtctatggttatgtcgaccaccgggatgataaccgggcgatgaagcggatcaacgcagcaattgaaaagtatcatttacaaggtgcgatcaagttgcacgattacaccaatgatgtcggagccgttcaacggaatgctcaggtttatgcacttgcatccgtgatggaaggctttaatctgtctttgatggaagcactcagcaacggcatggttggggtcacctatgatgtcaactatggcccgaatgaattagttgttgatggcaaaaatggttttgttgtgccatttggcgatattaaggcgatggccgctaagtttgttgaactattcacccatccggatgaattacagcaaatgtcagaccaagcctatgagttgtcggatcgctattcggaagcgaatgtttggaaggcgtggcaagcgttattagatgatgctaaaaagaaggatattcattacactgaagagatatccgctggtattggcgatcaacgggtaaagaaagcgtaaagctccggttttagatttaaaggaactgctaaagtgctcgttattttagaacgaaacaagtgatcgttattttagaacgaaacactttttaaattcttctcaaaacagtacaattagataaatcaaccttaaatgaaggcgggcgcctgaatgaatgacaaattaaagattattgaattacttaagcaacaagtagcagcgaaaacagctgaactgacgcctaagaatattcagaaaataacgcaagacattcaagatttactgaaacttttaaatgacgttgtagccattgattttgttgacactacttctgaaacgagtccgcaacaagagaatacagcagttgcaaaacctgaatctaatgcggcagttgcgccgatgattacccaaacagcgcctgaaactaaaagtgaaccaaagcagcagacgcaaccgcagcaaccccaacagccaaaaccgtcgcagccaaaatccaatcctgaaccggaaacaccattattatcagagcactggttaaataatcataagtcgtacattggtcgcttccatttagatttgaacggcggccatgtcggcaccattaaagtgtcggaaagtaagttacataaaatgaagaacccaccggaaaatggggactgggtgcgtgccgatgagtatcaggatagcgatagtgttaattacaagattacaacgttgaagcgcgatccgttgccaaccgaaattgtacggttgaagtttttgcctgctgtttttcgtgaagatgtgaagcggtggtatattgagtttcaatcaccggaacacgagacgcggcagcagttgcttttaggcgattatgatgtgatgttgtttaagttgaagccgggagattatattgactacgcttatcggcgcggtcaggaaatcaatggtaagatcatttggcgttacactgattccgcggcggttgcgacccgaatgaaacaacgctatgcaaagtcggcgaatacagacgctgataaaaacactgcaactagtaagcagaaagcaacacaaacagcgaacaagacggtcaagcctgcaaagaggcggcgagctgtccagcaagtctttgccgataaaaccttgctgctggtttgttttgaaaactccgccatgccgcgtaaagtcaagcgccatgttgaagaacgcggtggcaaactcgtgttatcatcacactcggattccggcgcgatgttgaagaaaaaagttcaaaaatctgatgtggtgattgtgacgaccgattttgttggccatagtcaaatgtttgcggctaaggatgaggcgaagcggatcgggaagccgatttggatggcgagaaataccaatgagcgtaatttgctgcagtggtacaaacgacattttcctaatgaaagtaagccatctgcggcgcgccaggaagtctaatgaatgagctagaatcaatcattgtgtcacttaatactaaaattttatattaaaaaaaccggtcctgagtgttttgcagtgtgtgctgactgctcagggccggttttttaaatgtgaacttctaaatacaacgggatattcaggcttcttgtccaattcgtggccaagttgcataagttgcgaccatgcgatccaaggcttctttgagtaacgggcgcggcatgccgatgttgagacgcacgaagccgccaccatcagccacaaaatagctgccgaccacacaggacaaatcagcagcagtaaagaaacgtttcatcgccgtttcatcagggaaaagccgctgggtgtccagccaggctagaaaaccggaatcggaaggcatcacctgaatttccggtatgacttgcaaacggttgaccaagtaggcaaagttagcggcgacataagccaccatttcatccagccacgcatcacaatccgtataagcagcgatgagggctggcacggcaaagctattaggtgaggtaatcgaattggcgacgaattgagcgttgagtcgggcgcggatcgctgggtcagggatgacgacataggacgttttcagaccgcctaaattgaaagctttattgggtgataaacaaagaatactttgggattgaatagctgggcaggcttgccagatgctggtaaatgtgacgccgggataaacaatgtcccggtgaatttcgtcactaatgagtaaaacctgatgctggcggcaaagttcacccacgcgtgctagttcttcagctgtccagacgcggccggacggattttgcggactgcagagaatgaacatcttaacgtccggccgttgcattttagcggccatgtctgcaaagtcgaattcgtagcgattgtccacaagcatgagcggactggtggcgagctgacggtggttattgcgcacggcttcagcaaacggatcataggccggcgtgttgattaacaccgcttcattttgttcggtgaatgcctgaaccaagtagtggagggtcggcacggtgccatagctgagtttgatccagtctttttccagttgcaacccgaagcggcgcgcgttccaggcgatgactgtctcataaaaggcttcggggatgtaagtgtaactgtagtcaggtacggccgcgcgtgtcataatggcttggtgaatcggcggggcaaccgggaagtcaaaatcggccaagtccatgggaatcgcattggccgtgagcccgaatttttccgcgagcacttgatccgcccacttccgcgcattgccggctttgcgatcaaaaaggcgattaaattggctcatgttcaagcacctccaattgattcatctgccgagatgtttggtttaacacgcgcgcgccggtttcggtgatgacaacatcatcttcaatgcggacgccgccaatgccgggaagataggcgcccggttcgattgtgacaatcatacccggcgctaaaacggtttgactgcgggggttgagaattggctgatcgccgcctagtcccaagccgtgccctaaaccatgcgtgaaacagtcaccatagccagcagcggtcaaaacgccacggacaatggcatcgacttcacgaccttgcatgccaggcttcaaagcagcaattgccgtttgttgggcgtccagaaccgccgcatggactgcggcaagttctgcgggtggcttgccgatgctgagtgtccgcgtcatatcggactgataatcagctaaaacaatcccaaaatcaatggtgatgagttcgttttcctgcagtattcgctcgctgggtcggccatgcggaaacgcaccccgcgggccactggcgataatcggatcaaacgccatccctgttgctcctgcttgcagtgtataaaaatataaccacgcattaagcgtttgttcgctgatgccggggcgaatatgcgggaggagttgggtaaaaattttgtcagtcatcgcacaggccgccgcaactgccgcaatttccgcttcgtccttgcgcatgcgttgttccatgatcaagtcatccgccaaactgagcgtccagttctgggcagctaaggtctgaaattctttaatcgaaaagccgttgctcaccaagccgatgcgccgactttgctgggaagttaagaagtcaatcaattgcggtaagtaagatccctgaggcacttcgatatttgtaaatccctgggtatctgcggcctctgcacgatagcggccatcgtggatttgcacggcctgcgttggggtcaccacgacatacacaccgctgccgggcaacgcgccgacatagcgtttactttggcgatcatgcagcagcaacgcgtccaaatgttgcgcgccgatcgctttttgtaagttggttaaatgattcatatgagcctccgttttaagtgcattgtttttcgaaaaagggatgcccgcgcaaacggtgcggcatcccattgtgagcattttttcagtaaccacagcatgcggcctgattagaagtcgagatccaagccagccaaggtatcctcgtcttcttttgaaaagattgatttctgcgatgctttcttggcttcattcttcaactcggcacgttccataaccttgaagaatggccagtacaaagcgactgctaggaacagctgcaaggcgttggctaggattgtccggtaatcgccattgattaagaaaccttccagaaagaccccaacgtacggcgggttgaaaatgggtttagcgatccaaccccagtgcatgaagaacattggcagggtgccgataatggcgccaccaaagacgtgcgggatgaacataatcggattcagaataatcggtgccccgaacagaatcggctcattgatgccaaacaaggcggggaataaggaaattttaccgattttacgataccgcttgctcttagacagcatgcaggcgaccacacagccgatggaaatgccgcaaccggtaaaaccaaagaaacttgaaacggcgccggctgtgtaaaaatgcggaattgcttcgccggcgttcattgcagcaatattttcggcgatgaacgtcaccataatcggactggtgatcggcgagaaaaccgacgagtgaattccaaagaagaagacagtacaaatggcgaagttaagcgccaagacagcccacggattatccatactcccaaccaatggcgccaagaagcgagtcaagatgcttggcggcagctcaccagccagattcaagaagataaagcggccggcaataaacgcaccgccagtaatgagtgtgaccggaatcagctcgaacgaacgggaaacaaaatccggcaccccatccggcatcttgatcgttaagtggtgagttttgcaccagtgatataactcaaccgtcagcaaggcaacaatcatgccggtaaataaaccgcgagcgccaaggttggcgacatccagttggccggttttgttaaaagttgcgaccatcatcaaaaaggcaaaacccgacaaggtgacacatccgggaatataaagcttgtaatgattacctaagttgtaagcaatggataagcaggcatacaagccgatcatcccgatggacagcttaacaggcaggtcgaacagcgcggcgttgccagtaatgaactgcgaaacggcatttttagggccgagcatattcggcagtgcggggatgatcgtgaaaatactgccgagaatcgtgaacggcgtcatagccaccatcccagccttaatggcactcagatgacgctgattatccactttatgggcgatgggcatgaagaagcggttcataaaagcttcgaacttgttaaacatcgtggtgcgctcctctcaaaattttgatcagccactaaccggcatgcttcttttgatattttgcgtgagtcaccagcgccagtttcatcaccgtggcaccatccatttgcccgtaaacatctttatcgatgacggcatacggaatatggcgcggatcacagatttccccaatatagccagtcttatgcccaatctggggaccgaccaaaacaatgtcatagttgtcgatttcttcttccagtccatcaaccggaatagcattaaaatgaaaatccgcttcgttcagtttgcgactgtctttaacaaccttcgccatattttgcatcaacatattggtggaaaagccacctgcacagcataaaagaattcgcatgattttgttctccttgtatatttattaatgtgagcgcgagccggcgcggttagaagcctgcttcattcacgctctagtttcaaatacctcaatcaacgtttcgatcaaatctcgtgccagttggctggtcatgtagtgatcttgcgcgtggaccatgagcagacttacgggttcgggcgtctggtccggtgcaaactcgcgcgcgatcatggccgtttgtgcgttgtgggcggcgacatcaatggcttttgactcggccagtaagttgcgggcccggtcaaagtcttgcgttttaacggcagccaatgcttcaaaggctttggttttgctttcgccggcgtttgcgatgagctgcataatttcgagttcttgagtagttgccatagggggtggactccttcttacaaacctgcagtgggtgggtgcagatgttttttaatcgttgggcgggcgctagtggtgaaacttttaaaaggtatgtgccgcggccacgagttttgctgataattggcggcacatcgcagcgtataaagcaaccatctgatcaacatcgcgggtgtgggcaagcgattgagcgcaatggccgtaacggcaagggaggattgtgaccaccgttggaatgccggatccgactttgtgtgcctcaccaccatcggtaccgccgccattaaacatatctaattgcaaagggatttctgctgcgactgcggttgctttaacaaactgttgcagatggcgatttggagctaaggtgcgatcaaagtgggtgagaatcggtcctttacctacttggcgctggttaacttcgccacgttcccgtggattttgaaaagttgccacatcgacaataaaagcaagatccggtttgatcagctgagtggcagttttggccccacgaatgccgacttcttcactgctagttgcggcaaaatgcaaggtgaacggcaatttttcatctgccagttctgcgagtagttgcgcgccgacgtagcagccgaggcgatcatctaaagctttgccgccaaagacgccatctggggcatacccatgaaactcggtcgcaaacgtcaccatatcaccgattgcgattcccaaggcagcgacgtcatcagcattgtttgcgccgacatcgcataaaacctgatcaaatgccggcaatgtgtcatcgcgaatgaccatgcccggaagcttgtgacccgcggcggttgtgatgcgtacgttctgccagtgactggcggcaggtttaacgccgccgacaaccatcagacgcagcagtccttcaggggtaatggtacgaaccatgtaccccacctcgtccatgtggccataaataatgactgaaaactgcggatcggcggcttctttggtgaaaataaggctgcctagcccgtcagtttggctggtcaatccatatggggcaaggtgatggcgcaaaaccgcgcgcacttcgctttcgttggctgcaatggcatcagcgttacttaacgccgccatcagttgtaaatccatgtcgtttcggctccttccagttcagtccgtaaagtttgttgaaatgcgctaaattcggtttggtgaactaattgattgatgagatcaggcttttgcattaacgcggccaattgggtggtcaaagttcggtgtaagggtaattgatcctgtttcaacgcaatcaaccacacaatgcgaaccgggcgcgcgctatttttgacgccagttggcaaaagcatcacggcgaccgcatttttcctggcgctgaatgacaaggggtgcggaatggcgatcccgttgtcgtaaaccgtcgccagaaagtcttcgcgctgcagaaccgaggctgcgtaaccaacttgtccgcaataagccgccattttagcagtgagggtggtgagtaacgtccgatagtcggcaggcttttgatcggggaaaaatagcgttgactgcaacaaatccgcaagggacgctgtggcatgatgttgcgatgccattgatagctcgtgtcgtaaactggcaaagtccaaatctgaagccacttcatcaatctgaatcacgggacaatcaaatgattcatttaaagccgtgacggtaaaaagcaagtccggtgaaagttggtggattgcttttaactcattgaggccaaaagtttgaatcaccgcctcaggaaaaatccgtcgcaggcgtaaactcagcagcgttgcaatgccgccaccagttccgcagatcacggcaatgcgataaccatgccggctccatttttcgtgagcctgttcaagtgggaccagcagatgggttgtcagatagccaacctcggtttttggtacctcgatttggtattcgcggcttaaccattgagcaaattgcactgcccagttaaaggcgatcgggtaatcgcgcgccaaaggttctagactcagaccggccagactttggtgttcttttagtcggccaattaaggcgaggacgtggaagtacatgagcgacaggaattccggatgcgtagcaaagttggtttcatggcgtgcatccagcgttgtgaaataagcgcgaagtttgttttttagccgctcatggtccagacgcgtggtcagttgtttgcgtttggcggcaaaactgacggttaaaaaatgccacgcctccggacttaggcgaatagcggctaaaatcgctgcaaagtcagtgtcagcaggcggggcgtgtaacgattggcccgtgacgacaagcgaccacccaatttcgctggcaaactgggtcgtgacagccggatcgagtcctaaaggctgcagttgctgagccagtgtcgcatgattgggcggtaacccatattgttgcagcgcatggatgcgactttgccagttgccttgaattcgcacgccgtaatgggctttgcggattaacgacaggggcgttccaaccagcagtttgtccaactcgcgtaaatcacgctgtaactgcttggtactaataagctgggtggcggccagttgcgccaccgtcaaatagtttgtggtcgataacagctgttgcagaagctcgggtaagcgtttggctggcatttttggctgagcctgacccgctaaagtcgcaagatacgcagctaaaagtttcgtatctgtaatctgtaattcataccctcgtccccgaataaatcggatttgaaaccctgacgcatcgtggtttagcaggcgcaaatcattttgcaacgtacgccgtgataccccaaccgctttggccaaggccatcgcggacataaccccgttagcttgtagtgcttgaatgatgagttgttcacgcaattgccttcccccaatccgtaagcgctttcaaccatattgtcagtatgccgcagaaacttcctgtcaaaaagtcccacttttgcaagctgacatggcaaaaatggcatgattgccaatgcgcctgccactggtcgtgaatgacgaatgatatagtgaccgtgcttattccctgcagtgtaccaatgtttgaggtggataacgatttgagctggtcgagaaaatagtgagacggcttggttagataatgagaggcatgacaaagggttggggcagtttacgataaaggggaaataaatgaaaaagttgcacgcaaaaagccccatgctgtttgcatgaggccgagtggatagagagctagcattaccggcatgcagcagacgcacgccaccaaaatgaatccttaactacgcaatatcgccatctgcgtttaactgcgccatatgaatcaaggtctcggcaattttacccattgcttctgttgagacgacttcatacgggccgtggaagttaatgccaccgttaaataagttaggagtagggataccttgataagtaatctttgagccatcggtgccgccgcggaatggaacggttttaggcgtcagaccagctgctttgatgccagcttcagccaagcggagcgggtaaggatctttattaataatatcggccatattgtaatattggtcgtgcatttcgactttaagccgcgggtggtcaaattgagcgtttagttcatcaatcgtcttttggaagtaagctttgcgggcttcgaattgttgatgatcaaagtcgcgaataatgtagaccaactctgcatcactgatttcgccgtggaatttcagaagtaaaaagtagccttcatgtccggcgctgaattccggccgatcaaatgccggtaatgcggcatcgagctgacggcctaaggtgttggcattgaccatcaatcccttggcctcgccgggatgaaccgaagtcccttcaatggtgacggtggcttgagcagcgttaaaagtctcgtattcaatttgcccgggatcaccattatccaaggtatacgcaaagtcggttgcaaagcctttcgcatcaaacttatcggccccaactccgatttcttcatccggaccgaagccaaatttaatcaggccgtgtttgacttccgggtgagccaacaaataacgagcggccgcaactgccccggcaatcccggccttatcatcaacacccagtaacgtcgtgccgtcgctggtgattaaggtctgaccaaaatattgcttcaacgcggggaactgttcaactgtgagactcaagccattggcaaagttgatcggtttgccatcgtaatgcggatggacttgtggctgcacattctcggcgttgtaatcagccgtatccaaatgcgcgatgatgccgaagcttttgaccggcttatcagtgttggccggcaaggtggcggtgacaaagccattttccgggtttaagccaacgtcttggagtccgagttcttgcagctgggttactaataacttggccagttcggtttggccaggcgttgatggggtggtggcgcgtcccggataagaccgggtgttgattttggcatagcgaatgaaatctgtttggatttggttcaaatcaagttcaattgtcaatgagaatccctgcctttttgatgagaaaaatattaatattccattgcaattagtgtgagactggcttagtattttgtcaatagcacaataagggaattattggagggcgcatatgaaaatatccaaaaaatggacgctagtgttgccggttgctgctgtactgcttctggccgccggatgttcgtcaagtagcagtagcagcagtggcaagtcgagcactaaccagacgcttaactggtcggaaacctcgtcaatcgtcactaacgatccatcgcaatcaactgacacggtatcgtttcagacgatgaccaacacgcaggaagggatttatcggttaacggataaaggccaaaagccgcagttggccttggcgaagaaagtgacgaccagtcaagatgggctgacctatcatgtcacattgcgcaatgctaagtggagcaatggcgatccgattacggcgcaggattttgtctatagttggcagcgcacggttgatcctaagaccaaagccaccgatgccttttattttgctccggttaaaaatgccaatgcaatcattaagggtacgaaaccggccagcgatctgggcattaaagccacggataaacatcacctaaccatcacgttggaaaatccgactgcttacttcaagaagttgctagccttcccactgtattatccgcaaaatcaaaaagtggtggaaaaatacggcaagaaatttggaacttcggcaaccacccaggtttatagtgggccgtttaagctgaccaaatggaacgggacgggtgatagctggacgttggttaagaacccgcagtattgggataaaaaacatgtgaagctggccaagatcaatgaaaccgtcattaaagatgttcaaaccggcatgaatctatatcaaacgaagaaactggattcgatcgtgctgactggcgaacaggcagccgcacatctgaatgacaaagacgcggttaagcgcatttcctccaatatgacccgcgtggacttgaatcaaaaacaagtaccagccttcaaaaatgttaaagtgcgccaagccttttctctgatgattaatcgtgccgcactgacaaagaaggttctgaaagatggctccaagccagccttgggttttgttccaattggactgcatacgaaccagaaaaccggtgccgactttgccaaaaccacgcaggtgaaaagtgcggttgcttacgacaaggacaaagccaagaaattgtttgaagcagggatgaaagaagccggtcaaagccagctcaacttgaccctgttagcagatgatgcagatgtttccaagcaggtagccgaatacttgcaaggcgcgtttgaagatttgccaaatgtcaaagtgacgattaagagcatccccaaggcccaacgcctgcaagcaatgatgtcaagcaactacgatatggtcgtcaccggctggcaatccatctttgcggacgcgtacaacttcttggatgtgtggatcagcaattccagctacaacacatccggttacaaagatgacaaactggatcagctgttgagtgaaacggaaaccaagtacggcaatgaaccccagaaacgctggaccatgttgcaggatgccgaaaagatcttgatgaaagaccaaggtacgctgccgttgtatcaagccaataacttgcagctattgcggtcaagtgtcaaaggtgtatcgtttaatcctaacgggacaccatatgactttaaaactgcatacatccaataatattgggataacaaaaaagcccgccatgctagtgacacggagattaaccgtgaagcatgacgggctttttgcattcattgacaaaattatttcaagatggagtgactcaaaatataaaaagcttcctgactagcttgatgatgcttgggcttttccgggaacccctcatcgaatttgcgtgcgtccgcggggtcataagtcatggcgggactttcatggtagaaccacttctgcccggctagcgtttgcggctgcaactctttgactaacatcgcggttggttgggtattgtccgccgcccaaacgttgaatttttgacagctttgaaagccgcgggcgacgtaattgtcaggatcgccaaaaatgacaatcgcgccatagccaaggttggctgcttgctgcatggatgcttcgattagttgctttccgaacccacgtcgctgataagctggcgtgatactgaccggtccgaatgtcacaataggcttctccaaaccggttgcagtcaccaatttactcttggtatacatgatgttgccaataatctgtccgtccagcgttatgacaagatccagttcaggaatgaagtcagcgtgatcgcgtaaaatatgggctagataatgttcatcggccccaggcacataaagattccagaaagcattgcgatgaatggtttcaactgtccggtaatcggatggctgttcagtacgaatggtgatgtttgtggtcaagattaagtctcctaagaaaagttgtaattcgggactacttttatttggaataaaaatttttagagaaaaatttaatcagaaaaaagtaattataaaagtgtgggaaaagctcgggaatgaggcacttacataaagtgcgaaataaaaatcgaaactgccgttatcttacgcagcttcggcaagataacggccaatctgataagctgaggccagcagataaggataatgagcggtggtacctgattcagaaagtaggtggtgtgtatgggcaaattgtcgataacccacacattgatgagaaaggtgcacctgtttgtcagtgatcgatgttgtaacagcgatcacggcctgcgtttgttcgttggtagtcttagtcattggggtaactcagttgatcaaggcgacgaccaagctgcttcatgcagtaaacgaactcatgcaggcgctcgaattatttcgagaaaaataggcaaactaaaagccgcaattccttcgctgggatgccgcggcttttagttgcctaatcctagttaccatcgttcattagatgggtctgcaagggcgaatgcccagccgtcgtgctcgaacgcgacggctttttgcttgctttaagtatagcatggcagctcagaatatttctagtcagacgacaaaaaatatgttgagtgattggttgaggcaatatgcgaactcatacaggcgctcgaattatttcgagaaaaataggcaaactaaaagccgcaagtccttccccgggattcggcggcttttagttgcttaattccaagtgccatcgttcattagatgggtctggaagggcgaatgcccggccgtcgtgcgcaaacgcgacggctttttgcttgccgtaagtatagcatggcagctcagaatatttctagtcagacagttgtaaaatttcaaaagatgatttctaagtgaacgtccgatacatttgatagatgaaagataactcatgtttcattcaaattcgtttcctgacatggcaattattcagtttcagactgcgaaagccctttaacgtagccttctgcctgcattcggtacatttcggcataggctgcattcgtttgcatcagcacttgatggggcgcaaagccaacaaccttgccggccttaaggaataacactttgtctgccatcgttacggaagaaagtcgatgggtgacaaaaagaacggttttattttgacttagctcggcaaaatgttgataaatttcaaactcactgcgcggatcaattgcagcggttggttcatccagaatcgctaggtgggcatggtcgtcatttaagaaagcccgggctatggcaattttttgccactggccaccagagatttcaatgccatcttcatattgcttgccaaaatgcgtttgcaagtcaatctgctggtttgaaaagttatcccatgcgctggcttttttcagtgccaattcaacattctgcgcgttaaagtttggcagatcggcaatgcccacgctttccagcagtgacaagttgaacttggaataatcttgaaagacaacgcgaatttggtggcgataagcatcgacgtttaattgctctatcggcgtaccgttaattaaaatctgacccgaagaaacatcgtataggcgtaataagagcttaaccagcgtggacttaccagagccgttttcgcccacaaccgccacagttgtaccgggatcaagcttaaaattgacgtgttgcaaaacggttttgtgattcgtttcggggtaagcaaaagaaacatcgcgaaattcaattgcaaatggtttgtctggcaaagctgcggcattttggggtgtggttaagacgtctttcttgttcaaaaattgataatacttctgcataaataacaacgtatcatacaacaggcttgagctttcgactaaacttcccagactttgggacaacgaaacgacggtcactgcaaatgtgagtaaggaagccacgggatagttgccactttgaatgccaacgatgactaaatacagtgaagcaaccagcgccaccccgttgatgaaggcatagacgcctgaaatacgcatttgcttcaaacggacttgactgaggcgacggtgaatttgctggaatgtatgctgatacttcttgataaaaaaatcaaaggcattaaaaatccgaacttccttggcatccgtattcgccagtaacgttttggcgtagtattgcattttacgggattgcgggcttcggtccaccatcgtttcaaaggcgtcttgttggatcttataggtgaaaattgcttgcggaataatcggtaataaaaccaataagatcacaacaaaattaaactgtgacaataagacgatgtatgacacgattgataaggttccccgcagaagatcaaggccgaaaacgatcaggttaaccggccgccagctggcttgggaccgaataaactccagctcgtcataataggtcgctgtttcaaatgttgcgatgcctttgagctttttggcgtgtgccatcaaggctaaattgatatgcgcgacaagttggtctgtcagtaagccttgcgttaacgtgacaaccggcccggcaatacccaaggcgatcaccgagacactccaaacgacagctggtgcgagcggtgaatcgtggtgacttaatgcagtcaaaagtgcctgagaaccggcaatcgttgctgcaggcagaatggactgaatgggcaccagaataaaaagaatggttgcgtacaaaggtgaggctttaaagaactcgcgcaaactcttccagtataagtttagaaaattggctaaggttttaaccatgctcgcaccttcttatcgttttctaatatttaggacgattatagcatgtgatggcacgcggcatacagttgatttccaagtgctagcggtttcaaataaaacatgctatactgcctttacaatcgaatagaaacatttggggtgctgaaaagctgagataatacccatggaacctgatgcagttagtactgccgcagggaaatgtcgctaagatcaatcgttttatgacgatgcttatttgtgatttcatggaccccgccagtgtttggtgccgggtcctttttctttgagttgacctgttcgctaaccgattggcgggagaagttgatggagattcacacataaacatggttatgactgattgtgactgcttaggcccccgtctgtcttttgttcgaagaaagaggggcttttttgatggatagatggtctttgcgtgacgtggtcttgttggcgtttttagccttcttgtttggcggtgtcttcatgggtgccgatgcaatttatgccgtgttggcggcggctttgacaccactgggctatgcaccttttgctaacgagattctgtttggcatgtgggtgatggctgcaccgatgacgaccatgctgttgcggaagaaagggagttcaattcttggtgagtgtttggctgcgttggccgaaatgctttatggctcttattttggccctgccgttttgctatccggttttgttcagggactaggtagcgaggccggatttattgtgacgcgataccggcgctatgacacggtgagcttgcttttggcggcagtgggcaccaccttgtttagtttcacttatgaatacttcaagctgggttatggcgcgtacagcttcggcatgatcttaggcttggtcacggtacgtttattgtccgtcattttctttggcgtcgttttggtgcagttggtcatgaagctttacgagcaagcagctggtgtcaagcgccttgctggcaggtaaaagtcaatgggaattaggttgaaagatttacagttccaccgggaaacgccgctgtttgatcacctgagttttgagtttgcgacaggtgcgttaacggtcctgacaggtgatagcggcagtggcaaatccacattactcaatttaatcgccgggtttgcgccaatgacctattccggcacgattttacttgataatcatgatctcagcggagccagtatgcaggcaaaagcgcagcaggtcggcatgttgttccaaaatcctgatcaacaatttaccatgcggacgttaagcggcgaactcgcctttgcgttggagaatctcggcttgtctgcagcagccatggcccaaagaagtaagcaggccgtggcactgggcgatacgcaagcgttgttaaatcgtgacttgcagacactttccggtggtgaaaagcagcgggcagcattaaccgttttgctagcaatgaatccgcccattttattgctggatgaaccgtttgccagtattgatccggtcagccgccagcagttgattaccaagttaggccgattgcgcgatgctggtaaaacgattgtgattgcggatcacgatttgcgtgattacgccggagtagccgatgcgctagttgctttgaaagacggccagctgaccaggctgccactcacaactttgaccacgattcccacccggtttgacttaacccaagccaatgcagccaccgtttcgttgctacgatttgaccaagttgtctgcgcccggaatcaccaaattttggtgcaggctccgacatggcagtttaataccggtatcacgactttgacaggcgctaatggtagcggcaagtcaaccttgctgcgggcaatggtgcagttgcatccgtatcgcggccggatgtttctcgacagccgccgattacgccgcactaaaaaactgtaccggacgatgacattggcggtacaggatgccggcaagcagtttgtcacattgactcccgccgatgaacttgcatttgggccagccttgacgccaaaagtacgcaaacgccaggcagctgcccttgcctatttgggactgacaggaaaacaaaccggcagcctgtatcacttgagcgaaggccagaaaaaaatggtgcagctgatcgcaatgttaagcctggagcgaacttttttgctgttagatgaaccgtttagcggcttagatgaacgtgcctgtgcattctttgccgcgtggatcaaggaaaaagcagctaagcaggcgtttttgattgtgacgcaccgactggctccgctagctggcatcagtcaccagcatgtggcacttgccgatcaccggttacacattctacaggagtgacatgatgccagtaaaaaagaccaatgcagtgaatctgagtttatttattctgctgctgacacttgaaatatctttcagccatgcggtgagtcttaatgtagcgttgatcggactggcaagcggttttttaatatggcggcgggcgtttaacagtctcgtcgttttggccttgttaccgttgatcccggctgccagcacgtactgggcaattaccctgcatggtacggatacgacttacgctttgttgctgtgggttcgcacctatgctttcaccgcgttggggttggtgtttcttatcggggttgacttagagaccttgctgttatggctggagcagcataaattatcccctaattttgtttacggattactggttgtgattcacgccttgccgcaaatcatgcatgaagtggctgctattcgtgaagcgagtctgttacgtggccaaaagttgcacgcgtggtcgccgatgatttatgtgaaggtgatttttgtggccatgtcgtggcaggaccagtacgtcaaagccatgtatgcccatggttataccgaaggagcagcgcgaacggttcaccaaaccatccgtagttcatggtgcggcttgatcgccatggtggggggctttgtccttttgaatctaattgcccgttagtttgaggatcaaaaagaggtggtcgcgcggtgtttaagcgattgtgcagggaccgacaccgcccgcgacagattaacgcgtactacaacaaagtcattaaatgaaggagtgcttatgaaattttccaaaattgcccggcaacaagttgtgccgtactgggaaggcagtttttcccatccgtttttgactgaattgcaagccgggacgcttgatccggccattttccgctattatctcattcaagatgcgtattatttaaaacattttagtcggttgtatgcgttaatcgcccagcaggctcaggaatcagacctgaaagcttatgcagcgcaatccgccgcgggactggcagaaggcgagttggcggtgcggcgggacttttttgacacgctgatgatcaccgacgtcgaagtggcagcaactgccattgcgccgaccgcctaccattatgtatcgcatatgtatcgccaattagttgccggaacgccgcacgtggccatcgcggggatgttgccgtgtccgtggttatatcaagaagtcgggcaatatctagcccagcgccaatcaccggtgccaatttatcaacgctggattgaaacatacagcggagcggccaacgcggatgatcagcaggccgcggtggcattggtcgatcgattatacgatcacagcacatcggcagaacagcagcagatgctagccgcttttcgaatcagtactcagatggaatacagcttttgggagatggcctatcacctggaaaagtggccggaagggagtcgcaacaatgacgcaaaatcgcgttaaacggctagcaatattggccatgatgatcgcattggacgtggtgttgtcacctttatttcgaattgaagggatggcgccgatgtcgagtgttgtcaatgttgttgctgccgttgttatggggccgctttatgccacagttatggcctttgcctgtgcgctgctgcggatgacattattgggcatcccgccgcttgctttaaccggcgcggtgtttggcgcactgttggctggaatcggttatcgcattggcaggcggtcggtatgggcagcagctggtgaaatcctcggcaccggtttgattggctcgctgttgtcatacccggtgatggtttggttcaccggcagcagtcagtcgctatactggttcgtctacacaccgcgatttttcggcggcgcgatttccggctcgctgattgccttgtttgtgttatacgaacttgaccatagtggcttaacccgccggctgcaaaagatcttttaaccgctttacccgcacttcaaaaagaataatttataggaggcacataccccatgaatcaatccgtaaccacaagctttaaacaggcgtttgaatccgccttgccactgacttcatcgccgttagttcaatgcattaccaatgaaattacagtcgagtccatggccaatgcgcttttgtacattgatgccaagccggtaatggccgatgccgtgcaggaatttccggaattttttgcccaaaataatgccttactgcttaacttgggacatatctcgccagaacgtgaaaagagtctgctagcggcgggtagttttgcggctgaaacgcataccccggttgtggttgatctggtcggtgtttccgccacccaattgcgatatgaattagggcatcagttgttggcgaatcacccgaatgtggttaaaggcaatatttccgagatgcgccgctttagtggtctgaaaagtaccggccgcggggtggatggcagccagctagatcaaagccctgccgcattttccgaacttgctgaagcgctgaagcagttgacccggcgttttcccgcgaccacttttttggcaaccgggcaaacagacttggtggtcagcgctcatggccagtggcgcctggaaaatggcgtcttgcaactggatcgcttcacgggaaccggtgatattgttggtgctttgattgcagcgctgcttggggtagggctcacaaacgatgcagctgtggtcgttgccgttagctattttaattgttgcggtgaagtggccgcagccgaaaacaccggcggcctcgcgtcatttagagagaggacactggatcaattatccttgttggcaacgcatcaagattggattcaaaaggtgaaaggacaggcactatgaatgcagaagctttacaactttatttagtcaccaaccggtacgccgattcgcctgaagtttttttagccaagattgccgcggcgtgtgaaaatggcgtcacaatggtgcaattacgggaaaaaagcctaacaacccgtgattattacgcgctggcaaaacaggttaaattgatcaccgaccgctatcgaattccgttgatcattgatgaccgggtggatgtttgtctagcagtcgacgcagccggggtgcatattggcgatgatgaattaccggttgcggttacgcggcagttgcttggtcccgacaaaatactgggcgtctcgaccaaaacagttgcgactgccaccgctgcagttacggccggtgctgattatcttggggtgggcgctatttttccaacccaaaccaaggccgctgctccgttgacgtcacttgcaacgctaaaagcaatcacagcggcagtttcagttccgatagtggcgattggtgggattaaggcggataatcttgacacctttaaggcaaccggaattgccggcgtggcgattgtcagcgagatcatgcaggcttcggatacggcacagaaggtccagactctcagcgctaaactgaaagaggtgttataaaatgaggattaacagcacgcctcaagtcgtcaccattgctggatcggattcaggcggtggtgccggtatgcaggcggatctcaaaacctttcaggcacgtcatgtgtttggcatgagtattgtggtggcactcacggcgcaaaacacatacggcgtccaagccagtttgccgattcctgacgatttcattgatgcacaatttcaatcattggcggcagactttgcgatcaaggcatgcaaaaccggcatgttagccgatagtgagcatgtgaacgccgttgtccgtaatcttaaacaggtcaatttcggtccgttgatcgtggaccccgttatggtcgcaaaaggcggggcaacgctgctggcaccggaagccgttgcaacgattaagcaggaactattgccgctagccgatgcggtgacgccgaacttgccggaagcagaaatcattgtggggcatcccattaagcgtgaaaccgatatgacagcggcagcgcaaacgattcaggaactcggcgtcaaaaatgtcatcatcaaaggtggccaccgtcaagatgcccaagcttcagacttcattttgttagcagacggcagcagtttttgggtacggtcgccacgcatcgccactggcaatacgcacggtaccggcgacactttttccgcctgtattgcggccgaattggcaaagggcgagtcactgaagaaggcgattatcacagccaaagcatttcttgaaggcgccattagccaaggcatttttgtgggccatggacacgggccgaccaatcattgggcaacgttaagcgaagacgttcaggtgagcgcggtaaaatcatcgtctagtttgcagggatagcaacctagccagaggcatcgaaagtaagtcactcattatgatggggtggcttattttttagtaaaaatatttttataaaacgctaccaattcccgtgtaacaacgatctgaaacgttggtatagactggcacagcgctgtgaaacactattatttttatgaagcttcatttatacttacggcaaggagatgcgaggttctcgatcggcgttcaaaagcgtggctgactgtctggtttaccgtcattaaatcggtggatgaccggtgattaaaatggcattcggacacgtttaacctgacgatcagaacccacgcaagtcagcttggtgcccgggtaactggaagcttaagcgacccgcactcctagtttgtatttggaggcaataaattgtgcaagaaaatgaactgacaccccagcgttatatgagctggccagttttgagtttacttgtttttattacggttattggttttgaaaacatcttctacccatttcaaaatcaaggcctgtctgttgtgatcaactgggtgattttattaatcgtctacatcgtcccgtacgcgctgattgcggcacagctggggacgacttttacccgggctgatgaaggtggcgggttggcaacctggatgcggcggacgctgggggatacctggggttattggaccagctggatttattgggctcagacgctgccttatctggttgacgtgtccaatgccgttatcgtggcgctttcgtggatgattctcggcgacaatagcttgggtaagcggatgtcgaatctgacatttggcttgctgacgtttgccattattcttttattcatcgtcttggagaatctgttctcgcggtcgcttgaagtaatgtcgcttatcggcggagcagccatgtttttgatggcggtgctgtttgtggcgttgaccgcggcgggattggctaaggggatgccttcagccacgcactttagttgggacgcatttcgaccccatttttcactgcattattttgcgaccaccgggctgctgatttttgccacttccggtgcggagctgggggctacgtatatcgcgcagttgcggaacccgaagaagcaatttcctaaagcgatgtgggcactggcactgatgaccgggtttttggtgattttcggttcgctcgcattaggcgtgtggttcaacgccaaccatctgccggatgacttgaaaatgaacggcgcctactatgccttttccatgctaggtaaggcgtggggctggggtaaaacgctgatgtatctgtttgcggttacgcagctgttgttcatgttggctcagctggcggtattgattgatgcctctagccgtgtgttgtctgccgatacggcgatgcgctttatgccgaagtggttactgcagaagaataagcaagggcggccagtacatagctatattttcaccgcctcactttgcttgttcctgttgttgctgtcgggcacattgccgaacatcaatgcaattttcaactggctgctgaatttaaacggcattgtgtcaccgtataaaacggcgctcgtgttcgtggccttcctggcgttgcgcgctcaagccgacaaatttacgtccggctacacctttatcaagagcaaaaccggtgcctatctagtcggcggctggtgcttcgtctttacctttatctgtgcaacactaggcttcttacctcaggaagttgtgtttggaaccaacggctggacccatcagctcatcatgaatatcatctccgtcatcgtcctcttcggctttggtttcatcatgccgctgttggcacgacgagatgtgatcaaggaaaaattgctgtaagcagcagctgaatcgttatcccgaaaagttttgggataacgatttatttttttgcatcgaagaaagtgtcgggcgcaatatgaccaacaaaaaaagtttcacagatattgaacagaattcacaaactgattgataccactgttatgcaacagaatcatgttttcagcaatacagatacgcacctcaagttaacaaaaagtctggttcacacaagatccgtgagatgacactttgcaggccggtgtatagcagttaattcacctaacaaaccagcctcatgttcatttaagttaaatttgtttcatgaaaaatgatttgatttagttgacagcgcttccatgtgcggggtaagcttggtttgcaagattaagtaaaacgttttacctaactcagcaaatagggtcgtggttggtgtgaagaagaaagtttcgattacggacgtggccaaggaaaccgggctttccgtcaccactgtttcgcaaattttaaatggcaaaggcgcgcggtttagcgaaaagtcacgcaaacgggtgctggccgctaaagaagcattgggctatgagccggatctttttgcccggggcctggtcggcaagcgcggcaactcaatcggggtcgtgattcccgatatgatgaacccattcttcgccagctttgtcgtcagcgtggaaaaagccgccattccgcgcgggctgtttccgcaaatcttttcgattaatgggttccatgaaaatgttgattattttattcgacagtttctgggtggcacccaacgcggtctgattcttgcggcgccggaagcttcacaggaaattgtccaaaaagtcgggaagcagttgaatctgcccatggtgtttacggatcaggcgaccacgctgatgaccggcgacagcattcggattgacgaacggcatgccgggtttctggtggccgatcacctgttgcagttgggccaccgccgcatcgcattcgtgttaccgcaacgattgactgttaacttgaaggatcggatggcaggttatcagcaagcatttgcgcagtatggggtccagctagatccggcgctgattttccccagcgcgtttaatccggaaggcggtcggcaagcggtggcacagatcgtcaagaccaatgccacggcgatcatcgcgatcaatgatgatgtcgccagtggagtctaccgcggcttgtatgagcaacacaagcggataccggctgactacgcggtggtcggattcgatgatgtcagccaggcacgcttcatgacaccaggtttaaccaccctcgcccagccaattgatcagttaggccaacaagctgttgaactcctggttgcgcagatgagtggcgagcataacacacgtaacacgattgaactgccagtgaaattggtgaaacgcggctcaacgaaaatagcaaaccaccgcggctaatcgtcatggcattttcacaaggagggggaagcattgaaaaaagggactgtcatcaacactcaactgtcacaagtgattgccgatatggggcactttgacggcaagacgattaagaagaacatcgaatcgccactgtcattagtcaccaccgaggatgcgaacaagtaagcttcatgctatgctggtcaagcaatgtcgcgcggtaaggtaaacaaaaaaggggccgaatgcggtcccttttaaatggaaaaatggaggggtctttatgcctaatcatgttgtcgtcattggcagtatcaatgtggatgctattttacacattcaacgactgccacagccgggagaaacaattcaaatggatgctttttctaaagctgccggtggtgagggggccaatcaagcggttgcggcggcgcgatctggcgctaagaccagtttcatcgggcgtgtcggggatgatgccaatgctgctttcatgcgtggcgagttggtgaaaaatcaaattgatacccaatatgttgcgaccaccgcagacacggaaaccggacaggcatatattctgctccaagcatcgggccaaaactcgatcatcattcaacatggcgccaactttgaactgacgccagcggatgtgcagcgggcgactggcttgattcaatcggctgactttgtggttgctgaactggaaacgccggtagctgccacagccgaagcattcaaaatcgccaaagctgcggataaagtaactatcttaaaccctgcaccggcgcaaaaagatctgccagaagcgctgttgaaaaatgttgatctaatcgcgcccaacgagactgaaagcgaattgattaccggcattccggttaccgatgaagccagcatgcgccagtccgccgcgtattatcatcaactcggcatccgcggggtggtcatcacgcttggttcgaaagggtctttcatttcgctggatggtcaggcaaccctcgtcccggctttcaaggtcaaagctgtggatactacggcagcaggggatacctttatcggcgctttagtcagcaaccttcagcccgatctcggcaatattgtcgatgcggaaacttacgccagcatggccagctcgtttactgtccagaagctcggcgcattcccgtcgattccgatgggggatgaggtgcgtgcggggttggcgaaggttaaaatggatcctgcgtaaggttaatcgtgtccgaagaagatcagttagactaaaatcgcgtcaacttctcacaaaaaggggaggttgacgcgatttttaagattggcgttagcggcctatcgcttaaactatcgagacctttacttgcttgcctaaagcatttgcgattttggttagcgtttcgatgcttgtattatttccttgttcaatacgcgcaatcgttgtcttaggaacgcctgatttgtttgcaagttcctgttggctcaatcccgcattttgccttgcctctagaacagcgtaggcgcttgccagtttggctttttcagattcggctagcttcctgtagctggagtcttgcatcatctcggcgaagaaggcatccatatccgttgacgttgtttcagtaaatttctttatgttcttcaagattttttctctccctaactcggcatccgcgggctggtcatcacgcttggttcgaagggttccttcatttcggtgggtatagtagtgtttgtaacggttactgaatcacgtttaaaggtaaacacaaaccttctcctaatttctattagaacattgcgttttagtcagtcaatctgcttaaaaaaactgcaaaagaccttcttccaatttcgtaatgcaaaaatcataattacacaaataattccagcaaggaagccggaaagatgtgcaatttgtacaaatttttgcgcgtctgtcgcattctgtttcggcaatattcctaatataagagtaaagaatgccaccgttaaaatagccttcgtaattaaagaaaaatcaggtttctttattaaaaaagcaaacacggacattgggaacaaagcataaactgatatagacgcaccatagaacagacaaatgtatatgcttattcctaaggctgactgaatatacccgccaaacccaaagcagaaaataagggctccaatccaaccagaagtaaagaatccaatcacaagcgcgacacttccaattttccattctatgaaggggcctagaacaaccgttgggagaagattccacattaaatgattccattcaaagtgatatagcggaccagttattatatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactatataggaaaattcacctcttaaaactgaaggtatatttcccacaaagttggatgcaggaaccataaacgtattggttaaaattgaaaacaaaaagtagcaagaaactaatatacaacagatgacggaggtgcccttagctgctaaacctattgataaaagattcgatcttttcaagttctgtatcatggatatctaacctctttctttcgagtcggattcatgtctacaaatataagtattcaaaaaggcggacttgatctgttccgccttctttgttacctataggcctagttttgtttgatcataactctccaatcaaaaactagtttcttgcccaatgccggccagcattacggtattgatttgaagatccgtaatatggcgaaccatttgggcccggaaggtctgcaggagtaaaaatgtttctaccaataggcaaagcaccaccaccaccactgttgggtatgtgatcgccaccaattgtggtctgaagagtctcatctgagatcgtagtgatgctttcgaacttaatcatattaactttattcatgctattcctccatgcttgcgacaatagtgacattacgatgttaaactcatgagtgtagcgttaatatatcgcaacaaagtcaagtagtcaataaaaaatcaattttctgtagcaaaacgcttagtaagtattaaaaacgcaataaactaacattatatataattgttttaggccaaaaaagaaaatataaacttttgacgatgccatacggattgttaggaaagtaaagcgtggtcatagacacacaaaaacccttatgtggaaaatcgagccatattggcttttagataaattgactgaacgggcaattcccaccaagatgttcttgaatatttgaattgttgtccttcgcttgtgttctatatcaattagaagtttaaaaattctgtttgattggatggacgattggtaatttgtatttatgagtcatcctatagattggcgtttgttcatataacgtttggtttaaatctccacgatacggaatgatatttccgcccctgactttggtgagagaatttgaatctaactgtaagacattgtttaccagtttttcgagcattgaatatcttcctttccgaaggtgattgtttacgggactcactaaattagaatacacaacagtaaatggcacaaatcaattttccacaacactttaagaaaaaataatcaaatacattagtaatgattaaacgcattaaaaaccgtatgtaagtactgtacgcagtgatcactttgggtgtaattaatttgaacgccttgtcgatagttgaatacccagacattaatctttaacagatcaggatttttaatggattgagcgactacatgttgtcgcgcgtggcaacagttcatttcctatatatgcagggattacttgacatgctaagcgtcattgaggtgtttgggtttagattttgtatcgaggtacaaaagaggtcattattatgtggatcactaagcaacaacgaaaagattcaatcggcgggttaacattcctttatcgggtcgcaacgcgtgatccagtggatgcgcaacgaaggattgaaagaattattcttagaaatgcaatcaaaccaagtagagagaatttgacatttgactccttgggttgatacgcggtgtggaacccggattaccttgtgagaaattattatcaacttctgtttgaaatttggcattatgcagaaaaagtcaaaaaaggtgaaacagaatgatgtgccagctgtccctattcggtgaggtagctctattatcaagaaaatccgtgttcttatttatagatcgcgctagccgggagaaaaaaatagccgcttcccggacaggggaggcggctattgtgttgttatactgatttcctcaacttaaacgaactgtatcacatttgatcgttttagtcatctttaaatttaaatatcagcgagccggatttaaaattattgttgaaactagagcttttgaaagaaccgttgatgatgaaacgtaattttattgaaacaaaaaagaaaaaatcatttgcgaggaatttatgttgttacagaggcagacacgaccaacctaactgccggctataactatgttgagtataggatagcgagttactaaccttgcttcgagtaaagttgacaggaattgttactagttaaaagggtatgtgctatgaaatggcttagacttataagcattaaaagagtattgatatttggtgttattgctgccattggttgcaaagtaacagagctagcaacccacatagatccaaatgttgccagctatatttgggtgataggcctctttattacctataaagttgcagacgacatctcaattaaagttactgcaggtaaaaaaggggttaaattatagttgcttgacagtttctgatggatgtaatcggaatgattaatgtattaccgctcgcgcttaatcaagcgtcgcataatctttaacaagtggccattaattaaactgatcaagaattgtccaagactggcaaccagacattaaggtcacctatatgaagcgccaactatcattcagtgtaccccatctttcgaaagtatctttcaatgcttggcaacacctctggccgaagtggtggggcaatgaagtatagagatgttaagatccttttccatgcggacagtcgataataggcgcttaagtttgacggattctgatcgtagtctgcccagcgttgttgatcagtttttgcgagaacactcgttatttgctttaactgaacttggggactgcggctggcagtttgaatgattgtagcaagacgttcttcttcatcatcgaggaagggcgttttttgccagcttaaaatgttgggaataatcgctaaggcctgtttgatttgggcggggattactttggggtgtgcaactgcagcacttgccaagtcactaccatgtgcaacggcatgtgcccagcctttttcaggaataaagccacgccagtcctgttccaaacgaaggtagttgatagcccaatctaaccacgtattccgttgcttgatcgttaaaaaaggttcacgagcatctgtatccagaaagagagcgcctaataaagccgtgaatgtgcgcgtaaagactttatcactctgcggattgtcaatgccatcaaataattgcgctctttgagttgccaaatcggctaatagtttcttctgatgtttggtaaaacccggtgtttggaagccacgcgcgaacaaactataaacaagttgatcgcgaatcttactattggggtcaccaacatgatctagtagccaaatacactggttattcgtgaagcgcaatggatcttttgccaggctcagggtgacaagttcttggtacatgagagtcatctccttttcgatggtgagtcctttttaaacttataagacattataattttttggactcatgcagcccttgtatcacttgaagttaatcgttttcaactcggtcaaactttcggtagaattaagatgtgagaaagaacatacttcaagcaattcttttgaaggacatcaaaattgggtcaaattcttgtggcagtttagatgcagcacaaaaatagtcgtaaagttaagacagcaaaaagctcaagagcaagtgtctagatttactcttgagctttttgctttgtaaccgattgatcacaggaaaattactggaagcaattatatgggccgcggtttcttgtccatgaattgttcaagcatttttcaaatttatcatcgaaatgggttcgtggcccgtgttgatgaggagtgcctttgcccattccgttgacccagtttaaagttcccgggttataagagtcaccgccagagatctgctccaattccactatatccagaactgccaagctgtcttttcccaaataattcatcccctaaagagttttttgatagagctaacattatactatgctgaatgctctatttttaacataaataaaagaaaaagttttcataacactggttatgatgatattcttttgctcaaggggtgattcaaaatgaatgaaaaacaagtcattattgctaaaatgctggaattacaacatctttttgagaagcaaccagatggaatatcccaaaaggttgtcttaaaaataaaacaagcgatcggtaaacttgctagtaacaaaacagcagcaatcgatatttcagcacaagtacgtccgataagtcgttttatcagagatgaaatgttagagcatgattataatcttacgctagaacagcggacgctcctttttgacctagaaggcaaagcgcaagatattgaaaacaaattccaaacagcagcagattggatccttttttagcgactttgaacaaagcattgccaattaggcataacatgtcgtaaatatagccttatcctctttcgcacatacgaatctactcataataagtcgtgctgctcggagaataattttgtgtggtaattttaagagactaacaaatcacatgttaggatcaattggttaaaggtacccgaaagaatggcttttttgtgcgaaccttcttggcatacaagaaatgattaagcaagatagcgggtcaaaaaatacgtcaatttcaccggaatatgtgagattggcgtatcttcagaagtgacaattaacttagtacaaactagccacaaaaggcttcattgccgtcacgacatccccgctgccggtgccttcgatgagggcgacggtgaggtaggtgttcttgtcagcatccatggcgactaagaaaccattttccttgccgtctgtgtcctgtttctgcttgagttcggccgtgccggttttggcggcgatggtgtggccgtcgatggcgaggtcatgggcggtgccggcttgatcggagacaacgtgggtcaaagcagttttgaccgttttggcagcattgctttggagcacgctggtacgtttgccctttgcagcttgaatcaaggttggctgctgcatggtgccgtcattggcgatggcactgtacatcgccgcctgttcaattggcgatagcagcagctgcccttgaccataagcggtgtcggccaaaagcgtttcggaggcgagcttgccattgttggagatttgggcttttttcatggttaaaggtaagttggcttgggttttgaaaaggggctccagacctttgaggtaagcagaggcgcccattttcagtgctacttgagcaaaccagatgttgtcggagttaaccaaggcctgggtcatgttttccgggctggcgtcaacggtgcgggtcactttgtagtcgccccacgaactatctttttgccatttgagaccggaaatagatttggttgtgtcaggggtgatggttttgttttgcagggcaatcgcagccgttagcattttaaaagtggaacccggtgcgtatcgttgggtgaaccggctgaggaatggcagctcggtgttgttggcgtatttgtcatagttggtttggctgatgccgttcacgaaggcattgggatcgtagcttggcgaacttgctaaagttaaaagttcgccgttggttggatccatggtgaccacactgccacttttgcctgctagttgggtataggcggttttttgcttgttggcgtcaattgtcagcttcaggttcttgccggcaattgctttggtgtctagtaagggatggctgttgctgccgttgcgaatcgcgatcgtgccgccatccgtaccgcgcaagtaatggtcatagatttgttccaaaccggctttaccgattttgctgttggcagtcagtgacggatgctttttaaggtcatcggcggttgccgtaccaacgtatcccacgagttgagcagcagcctcgcccaacggataagtacgtgaaccgattgtttggtaagctgcaccggttaatgcaggggagtcggtgacgatcttgaccggcacaaatgtatcatcggtgacccaggattgcttgaggagcgtttcaagactcgaggttttcacatcccaggcggtcgcgattttttctagattagcggtccgttcatcgccggtacccagtttgccaggaaccaggccggcttgggtgacattgccgttggtggcgagcgcctggccattacgatcgagaattttcccgcgcgtggcagcggtcaaactaatctgaaccgtgtccttgccatccatttgtggaaacagcaggcttggcgtccagcgaatgcgccagttgtcgccgactttaacgatcggcgcggtgtaatgctgtgccgggagcttgccgattttggtgttcatattggcggtaaaagtgagttgataggtaccgtctttagaattagttgttttcagatccgtgattttgatgttgctggcgccgatccggtcgaaaacggcctgattgcgttcagccagcgtcttggcggtatattgccagcccggacctttgagatggctggtgtcgacttgtttaacggctttttcatattgacggttggcaaaagctttcgtgtaggcttgagccgtggccttaacctggtcgccttcagctttgccttggtaccagtgaaaggcaccgaagccacccacaatgacgacaattgctgcgaccacactaatcaggatggtgcgcgtcgatttcttcatgtctgttccccatttctagtttttacgcttctccatgtataacgccattctacgcttctgggtgaggggaagaaaccggggaaatataggcgcagggggtgaaggtgattggcaatgaggttgcttacaggaaaaaggccaccatgcaacatgaagcgcctctttatgaagactatttagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactatttacgttttagcttgtggttggcgcgaagaacaaggtatagtggatacaaaattgcaaagacgatgagggagaataccaataaattgaagattctttctgaagtcagccaggttattattaacgcaataataatgataacagtaacggtaatttgaagatgacgcgtattcataatttcctccgtctgatctaggttaatcgacttcatgttagtcattctttatgacatctttatcttaccttgtaggcgttattaatactagaacatagctgtccgtctaagagtcgatataagtcttgttccctgcattccaaaaaaatgggatgagttgatatgttggaggcaaacaatgagcgcaagaacagtcaagtttgatgagttcctaaaaaagcaactcgagaaccccgaatttcgtgagggatttgaagaagaaacctcaaagctagatagtgccgttgccttgatgagtgcaagagaagcacaaggattgacccagcgtgagttagcagaacgtgctggtgtgaaccgcaaataaagagaagtagaagtatggtgctaaaagaaatacgtggcagaaaagccttaaaataattgcttgcgcacgcaaataaatgcgactatactatcagctggaggtgagcatgtgttcaaacgctggctgatactcatgacgctcgggctgtttttctttatggtgattattgatggcaccattgtcgtcgtggcggttccaacgatcgcgcaggcattggcggtgcagcctagtcaggtgaatcttttgttgacggtgtatttgaccacgatcagcgtgtgtctgttgttttttggacagttagccgatcaagttggtcgaacgcgactttttattcacgggacgtattggtttttgcttggctcggcggtggctggattaggggtgaatctccagttggttttggcggctcgcgtcattcaggcggttggggcgagtatgaccatggcaacgagttatgccattgttgccgatgtttttccaccggcgttgctgggacgggcgctgggagttgagtcgatttttatttcgttaggcgcgctggctggtccgggaattggcggcttgattttaagccatctgccgtggggatttattttttgggtcaatttaccgattggcttagcgtgtgtggtgattgaatggctggtatttccgcgcgcatcacggtcgcaggcaaaagtacaactggatattcgcggattcctgatacttctactgctggggggattgttggtgatactgcagattaatcgccaaccccttgtgtcaggcgttttgctggcactgatggttgtcggcggtttgggattttggcaagttgagcgtcatgcagcccacgctttattggatgtgcagctgtttcggcaatccaggttcagccgtaatttaggcgcatcattgctgaattatatcggggcgtattttttcacgttgctggcgccgatttacttgcaagtgctgctcggcttgccggttgcgctggcggggatgttgttgatgttaccgccgctggtttcgctcgttgccaatccgctggcgggcgttttaagcgatcgcgttgaccaagggcggctaatgcaagtgggtctgggattgctggtgctcagtaatttggcgtttgccttggtaccaggtggccaacagctatggccatttatactggtcgccatgaccttcgctgtcggaaccgcgctgtttaccaatcccaacagcgtcatgctgattcaaagcgttgatgccaaaatgcgcgggcaggtgggtgcggcaacatcactggcacggcagttaggaatgagcatcggcagcgccttttcgagcttggtgttttatcaagttttggcaatgatgacgcccgcccgtaaccttgccaaaaccgcaccggcagcgttattggccgcacaacgagtgagtttccttgttgccgcaaacctctttttacttgccgcgatcatgttaagaaagaaggatggaaaatggattcagaaccagatgaactgatttcgcgggtgaacattctggcccgccagattcaacacgacttggatctgcggctgactccaaccagactcaatgccagtaattattactttattttgaagttaggcagcgttgacgacatgcggcaggatacccttttcaaaaagattcatcttaacgccagcaacgtgaccagacgcttggcgcaattgatcacgctgggactggtcaccaaggaaaaagcggcagatgataagcgcgcctgggtgatcagcttgacggcagaggggcgggcattggtgccgcgcgtaagccgaattgtcgccgagtacgaggcagagctgaccgcgaaactggcagctgcggacaaggttaggtttgaacaaatacttgacgtgctcaataaaacgaaagaggatgcgaatcgatgaaaaacgtgatggcgattttagggattccggcagattatcatgtggttcagacaacctcgcgaaccagaaacggtgaaccggtgacagtcgagcgtttgcagacttccgctgaaatcacgccaaacaacgcacacatgacgctggtccggaatgaagcgggaaccgtgatcagtttcaacgacagtacttttaaagctggtggaaaactgcctgctgctgaacgtgcgcgtcaccaagcaagccaactgtttcagcagctggattcgacatacgctgccaacttgacttacatgcgcactgaacgccaggagcgccactacttcgatcatggcgaacgcatcagcacaccggtttactggatcaagtttgcccaccgcaacggttcctacaactgggtgacgatcgggccggacaatcgcgttattgaagtggagcgcgagtcatactgggattactttaggaatcgccgcgccacggaaatgtggaattatgatgattgggtgctggcatatgaaggtaagggtccacagatggcggcaccgaatgcattggcgtgagtatcaggtgaaaagacaacctgctggtgagagagtgaaatacccttgatgaggcgagaaaagcagaaaggcagccttttggtgaaggaaaacacttttgaagtggtgaggagaagcaaaagggtagccttttggtaggataacgtcttgatgcgaagtcagagacagaaagaggcgatccagtggcaaaaccggattttgaaactttagtcgcgcggcttggtgacttacgggaagcggcgcgccggctggcagacgaggattatatcagcgcgcggtataagggttatagttcagaagggctcacgctggaggaagtgctggcgaagttggagacgacggagcatgagattgctaagttggagcgggcgttggaacggttggcggatgaggagtgagcttgtgaagcgcaaccgaaaatgatgcgtatgatagcaaattgctattgatttatgtcagcgagtttggcatcatcagtacgcggcagtagcttgagaaaagcccgctttggtgaggtgccaagacggttttctggcgaagattggctgctgggaaagaaaaaaccatcatggcgtcttgggataagtttgaaaagaaaatggatgcagtaatgcctccacaagaattaaacattattgatgcacttgccaaactccatagcgaacggattcggcgcgggatttcacagcgcgaacttgccaagaagattggcatgacgcaaccacagctagcaaaaattgagcggcttgactccgttccttctttcaatactttgaatcgttatgcagcagggctggggcttaagttgaagatttctataactgcttaaaaaatacaaacagcgatgcgattgacccgtgtggataaggagggtcaattgcatcgctgtttttatgatgtggcaggttattaatgaaatgtgtattggactgtcgggcaatgatgctaatctttgtctgaataaagatcttggcgaaaggtctatggagaattgaatgtcataggttattagcatgatcgtcaaaactttgtgatccacaaaagatttaatgtttcatcactgctgtcaatctccgcagcaacgccatggcctgcttacgtggcagtgtgccttcatcggccaaagctgtcaccgctgcttgcacaactcgcagataccggcgccatccggttgcgggcaaggattttttgacatccgccagcaatgcctgtagtgcatcgggagtccatcgcttgggtgtctgtaaggcttcagcgtacattcgggtgtggaagtcaatcatgaaagcaatgaaaaccggtgttggcatgcccataaattcggttgcgtaaagatctcttctccgtaaatgtgttgccaaggagaagccttcacgatacattcgattgccagttactgtcgtccattcgtagcgaccgatttttgtggcatgcggcacctgactagcataggcctgagcagcgcatacccacgtcatgtttaatttaaatcccgcgagactgaacgtattgcatctccgggagctctgagtaagtctcaagtccggcagcgttaagcaaagtgacgcgattgaagttatcaggactaattgagatcatgtggctgcggccaagcttggcaatacccttgatgaaagcgtcaggatcgggtaggtgatgctgaaccattaacgtcaaaaacacctgaagaatcacaagtcgattgccatactcttgcggattcttttgataaggtcgcagctgattgacaacggcggtcaaaatttgatcggtatcagtccaaccttgaatgccatgaccagtctgcatgtacatcgtcgtacaaaacgtctgcaaagttgtcatgacagtgtcttcatcggtgaaatttaggattttcgtcgggattggagaggtcatgaatccgaggagcgtgcgctggatgttgttgagctgtgcttgtgacatggtgggagtcctttcgaggaggaaagttcggatggggacgttatcgttatcataggggatgtagggctttcatacaagcatgattcgtgccaaaaaagtgatggcagactttttaaatttgcgctgatattttccaaatcaaggagatatcagcgctttttattagcaattgaacaaatacgggttaaagcgattatgaagggtgattaattgtttattgctggtattagcgcatcttcatgcgcaatactgatcaaggtacaattcgtgtcctaagtgaaggaaaaagggtctactttttggaatgtaagcgactgttcatctcgaacaaagttggtgaaaacaagaaaatctgcactttgtctccattgggtaatccgtggaatgctaagactgagagaggcgatttgcagattctttaaaaagaaaatgtaaaaaatgaccagtgcaatggacaaatctcaggtaagcgctttcaaaaaattcgaatatgcttaatgtacaggagaggctaactatgatgttaaaaaatggacgtgagtataaacttcaactttttttggcacagactaatgagtttacaactgctgatgaaattgccaaacatctagatctgtcgaagaagactgtttatcgtcttataaaacaaatcaataacgctaagccaggtctcaaggtaattgaatcggccaaggggaggggatatcgactaaatcacgaagagtttatcttacagcgaaagacatttcaaagtgatgttgcggaaatttctcctattactcggcaagagaaagtgatggaagaattgttgctggcatcgcctaagtggttgaagctgagtcagttgtatgaagacttttatgttagagattctacgattgcaaatgacgaaaaagcgattaataagcgtctttcaaattacaacttaaaattggctagaaaaaatcgagcgttacaaataactggagaggaacctgaaattagaaaagccatcgtggaattattacagacacttgatgttgtggatattgaggacctgaagagcacgacaaatagcgaacttaatcaatttgatgtcgcactagtaacagagcaaatcggcaaaattgaaaagacactcggcgaaaaggtcccgtatccctacaatgtcaatttgttttcacatctgtatatccttatctcgcgagtgaaaaaagttgcggtagacactggagatcaaaagctaactgttcaagagagacaagtgatgaatgatgagccaaaaattgccaagattgcagaaaagaccattcaaagtatcgggatatatctcaataaacaattgcctgaagttgaacagtattatctctttcaatatttaatatcttctagattacctgaccaaactagtcaagttccaaatttttcagatgaagtcacaaaggtagccgatttttatttgtcgaaagtcggtcaacgtctgaacttagcggtcaatagttccacaatctttcacgaattagctaatcacgtaaagccaatgttgaatcgcttgagaaatggtattcgtgtgaagaatgttttattggagcagataaaactttcatatcagggtgttttcaaaattgtgacagaggtttcaaagatagtaagtaagaagtttaatttgcccgtaataagcgatgacgagaatggttttattacactttattttgctcgcatgaatgaggcccatcaattacctatacgtacacttgtcatgtgtactacaggaattggaacatctgaacttttaaaaacgaagctaaaaaagcattttccggaattggagattgttgacgtcattaatactcgagagtatcaacaatatctcgaaaaatatccaaaagtagaattgatcatcacaacagtgggccttaaagagaaagttcccattgcatcgttgctagtcagtgcaatgctgacgacagaagatcaagcaaggattcaaaagacaattgagggaattcggcatgaaaattgatcggatcttagtattcactaatgtcaacttaaaaaccagagaggaagtttaccagtttgttgtaaagcaagaattcccttctgacattgagaatgcaaaaaaactttctcgcgaattagtggatcgagaagcccaaggaaatattcagattgcggaaagtattgttttgccgcacgctgaatgcaactacattcaaaggtctaagcttcttttaatcaaaactcaaagaagcattgacacgtggtcttctgatatccatgacatcaaagtggtgattgtgatgcttcttaagtcggatgaatctcgtaacgtcaaaatgcagttcgtagatatcatgagacagcttggtaaggatgaacttatagagcaattgctatcggaagatgatccggaattgttgctgaaattgttgtcctaaccatcaaaaaatgtttataaatgcaactcgaagtaaaccaaaaaattaactaggtggtttggagtatggatgtaattaatattattgatcctaagatcgttgatacgagattaaatgtgaataataagtcggaagttgtaactaaattggctcaagatctatttaccaatggctatattgatgatgtttctgcttttgttgacgatgtctatctacgtgagttggaaggccagactggcatcggtggttatattgccattcctcatagcaagagtaaacacgtgaaaaaaattggtgtggcgattggaattaacaagaaggaaataccatgggaaacacttgatggaaaaggggtaaaagtagtcatattgtttgctgtcggagacgacaaggagtcagcaagggatcatctgaagcttttgtcactttttgcaaaaaagttagggagagaagaggttgttagtcgtcttcttgatgcaaaagacacgagtgatgttattgctgcgtttaaatgaaaaggagtgtttgagatgaagattgttggtgtagcagcgtgtactgttggtattgcgcatacctacattgcccaagaaaaattggaaactgcaggtaaaaacgcgggttctgaaattcatattgagacccaagggacaattggtgttgagaacgaacttacccccgaacaaatagaagaggctgatatcgttattttggcgattgatgtcaagatttctggggaggagcgctttaaaggtaagaaaatcattcaagtacctacagagattgccattaaatcgccaaacaaattgattgccaaggcaaaagagatcattgcagcatctgtctgaacttaaatgcacactagttgaggagggataaagatgaaagcattaaagtcgctcaatcttaaaggaaacttgttaaccgcgatttcatacttgatacctattgtttgtggagctggttttctcattgcaatcgggatggcattcggaggacacgcgcaagatgccctagttcagggtaaattcagcttttgggatgctttggccacgatgggcggaaaaggacttggcatgttacccgttgtgatttccacggggattgccttcgctatcgctgctaaaccaggtattgctccagggtttgttattggcctaactgctaatgcgattagtgcgggtttcatcgggggaatcttgggtggatttattgccgggtatctggtagttgcaattcttaaatatgttaaagttccagcttgggcaaaaggattaatgcccacgttattgattccttttattgcttcaattataggtggacttgtaatggtttacgttattggaggaccaatagcagcctttacagcgattctgacaggttttctcaagggactaagctcatcttccttacttgttttcggggcagttattggtctgctaagtggtgttgattatggcggcccaattaacaaaacagtctttgcgtttgttttgactttgcaagctgaaggtttgaacggaccgattacagctctgcaattggtcaatacagcaactccaattggttttggcctagcattctttgttgcaaagttatttggaaaaaacatttacacgaaagtagaagtagaaacgctaaagtcagctgttcctatgggcgttattaacattgttgaaggagttattcctttagttatgaatgacattgtccgaggtgtcattgcaactgctgttggcggtgcggctggtggtgctgtgtcaatggtgatgggtgcagacgccacagtaccatttggcggattcctcatgattccaacgatgtctcatccttgggctggtgttgctgcattagttgttaatattttggttactgcattcacattggccctcataaaaaagaatgtgagtgaagaagatttagagaagataaatcaagctgaggaagaagatatcgacttagacgatattaaagtcatttaaaaaccaagtttatataattggcaaatgaaaggaagcaaaaagaatgaagttttttcttgacacagcagatgtagaagcaatcaaacgaatcaataaattaggccttgtagatggtgtgacaaccaatccaactattatttcacgtgaaggcaggaatttcgaggaagttgtcaaggagattgcaaaccttgtaccaggaccgatttctgcagaagtgacagcaatgaaacctgaagaaatgattcgtcaagccgaacaaatggtcaaatgggccagcaatattgttatcaaacttccaatgacagaggccggcttgcaagcaaatcattatttgactgatgaggggattaagacaaatgtaacgctcgttttctcagtgactcagggacttatggctgcaaaatctggagcaacttttgtatcaccgtttgttgggcggttagacgacattggcacagatggtattgaattagtaagcaaattaagaaagatatttgatatctataattttaaaactcaaattattgcggccagcattcgtagtcgcgcacatgttgaatgtgctgctttaagtggtgctcacattgcaacgattcccccaaaactctttaatgaattacaaagtcatccactgaccgatcgtggtattgcgcaatttgctgaagattggaagaacttccaggaaatggaggtagtaaagagtcatgaataacattcagttttcaccgtccttaatgacgatgaacttaaatcaatttggtgaagagctaaagtttctgagcacaaaggttgattcgttccacattgacattatggatgggcactacgtaaagaatctcagtctatcaccctggtttattcaagaagtaagaaaggtgacgtcgcttcctctttcagctcatttgatggttgaagaccctgctttttgggttaatcaactgataaatttaaagtgtgaatggatttgtatgcatatcgaagtattgaatggcatcgcatttcgtcttattgatcaaattcatgaggccgggttgaaagctggagtggttttgaatccagaaacacctgtcagcacaatccttcctgttattgatctagttgacaagattacgattatgactgttgatcctggttttgccggccaaaggttcattgaagaggcgttgagtaagattgtggatttaaaagagattcggtcagagcatcattatgattatttgattgagatggatggctcatcaaaccgcagaaactttcccagaatcgcggaagcggggccagatatctatatcgttggccgaagcggtttatttgggctaacgaacaacattgagatgtcgtggggtaagatgacacaagattttcaagattcaaccggtttaaatctaagttgagtagaggactcgaacggtgttaacaagaaattctgaacctcctcaatgtttgattcgatagatgaacaaaaagtaaacaccttatgtatcttgtattaaagcattagggaccgttgaatcgcttgattatgaaaaaatcaaacagataaatttgaaagcgcttttcccagtgcagctatttctcatccagcggaaagacctgcacagctgtcttaaatgcatttggtagggcgcttctggggagaatttatattagcgactactgaacaaatcgatgagaagtcgcatcgaaagagggtgttcgaacaatgcttgatgatttaatcactcgggaaatgattcaattttctgataagacattagattggaaagaggcgatcaaacttgctgcaagacctctgaaggattttggctttattgaaccgcgttatatcgaggcgatgattaacaaggttgaaaaatatggagcctttattcatatagggaaaggcatcgctttgcctcacgcgcggccagaagaaggggcgaaaagggtaggcatgtcagttctaaagatgagccatccagttttattactgggacaaaaagagcatcccataacagtatttatttgtttgtctgctgttgataatacaatgcatttaaaagcattggcacagctgacaacgatactttccgatgagcataacttggcgtgtttgttaaacgctcagaatgatgaagagatcatctcagtattaagtgaaggagcgaaataaaatgaaaattgcagctgtttgtggatctggactggggtcaagtttcatggtcgagatgaatattcaaggcattttaaaagatcttggagtaaataatgtggaaactgctcattttgatgtcggtagcgcgatggaagggagtgccgattactttttcgtggggaaagatttagctgatagtctcagtaacttaaagaatgtgattgttctcgacagcattattgataaaaaggaattaaaagaaaagttagagccacttctaacaaaccaaagccaaggttaaatcgtcgccgaaaggaggattaataagatgaatggattcttgaaggtcttagttgatattgctagcacacctgcaattctagtcgctttaattgcaatcctaggtttggttttacaacgcaaacatgttagtgatgtgttgaagggtgggataaaaacttttgtggggtttttagtgttaacgtccggcgcaggtgttgttacaggatcgttgacaccgtttggaaagatgtttcaacaagcctttcatgtcacaggggtggttccaaacaatgaggctattattgctattgcaatcaaaaacttcggtaccgccactgcactgattatgcttttcggcatggcagccaacattctttttgcacgattaacgaagtttaagtatatcctcaattttcaagtcaagtgcaacgatgataacgaattcttgatagtggtctaggctgttacgccatgcatcggtagtaatcgcatgggcgaagatagttcagaatacgtctgggacgatggttcagtgcggattggactgcttgaatttcaaccagggtaactgctctgagggacttccctttcgggaagaattccctaagcagtccattggcgttctcgtttgtgccacgctcccaaggcgagtacggatgtgcgaagtaaatctgggttccaacaatctctgataacttggcaaactcggaaccattgtcaaaagtgatactctcaaattccttggccccgtagtcgtcgatcgtgtcctgcaaggctttaaggcaggtgtccgcatgatagtcaggaatcttgacgatgatctcagtccggctgtaccgttctgtgagcgtcattaatgctggctcatcagctaagcgaatacctttgaccaagtcgccttcccaatgtcccacgcctgtgcggtcattcacggccgcaggacgcaactcgattgagtcgccgtatatcttcttattcttgcgcttgtgggcgttcttatagcctttgatgcggcgtcggagcttcttgggaagtgtcatgttgtctagcgcaagcagcccggcgtcgatgtagcgatacacagttgtcgttgaagggcaagccttgccctggtcgcgatagaagtgtacgaagctatcaacgctgtgtacgcgcggcttacgagtaagctccctggcgagagccttgaagaacgcacggccggtcttaagaaaggcgtagtgaccggttctatcgcgtttacggtcgtgcatggcttgggcagtttccgcaagatagacttgatgcgagtgacgcttcgagtcgagctgagttacagatccacgcgtgatttctcgtgagattgtcgctttactgcgatgaagcttctgtgcaatcacggtcgcggtgtcaccagcagcctgaagggcctgaattgtagcacggtcgctaaaactgagttgttggtaatgcttgtgggtgttagtctgagagtgggtcatgaagattcctgctttcttgtttagctagcactaacaagaataggtcttcatggcctttatggtctagtcgtcagggtgttgcacttgaattgtaaactggggaagtttaagtatatctatttgactggtcatgcctttttctatcaggcatgtattatcgcggtggttttgactacaacaggaatgaacaatgttcttatgattgcggtgggtggcctttttctgggaatgtgtggatcggtctttcccgctattattcaaccctttactaaacaaattactggtacagatgatgtagctttggctcacacggggaactttggctatatgatcgccggttatattggaaaatggtttggaaataaaaataaatctacggaagatatcaattttccgaaaggtttggcctttcttcgagattcaacggttagcattgcactcactatgatggttgtgtacttaacggtggcgttattcactggatcaacctatatcgagactaaattgagtgcagggacaaactttatagtattttctcttcaacaagcgggaacatttgctgcaggtgtttatattatcttagctggagttcgcatgatcttggctgaaatcatccctgcttttaaagggatttcggagcgtttagtaccaaactctaaacctggactagactgtcctattgtctttccgtatgctccaaatgctgttttgatcggattcttttcaagctttcttggcggaatcgtaagtctcattattatggcgctgacggggacaacgattgttattccaggcgttgtaccacatttcttttgtggagcaacctcagcagtctatggaaatgcgactggaggaataagaggggccgtcctgggatcattcgttcaaggcgttgtcatcagcttcatgccgttgtttttaatgccattagtaagcaaccttggctttactgggtctactttctcagatacagattatggcattatcggtttacttctaggccaatcatcacgaatgggaggacagatcgcggttattgcagttattgcagtcgtagggatcacaatgtttttactcacagcagttagtgcaaagaataaaggtaaagatgaagaagcagcttaattttaggaaggtgaataaagttgaaacaaactgagttacgtgatattaagaaactcgctgcaaagattaggtatggtgcgatcaagtcaattcagttggctggtcagggtcatattggtggatcactttcagttgctgatctgttagcagttctttatggaaaacagatgaactttcgaccatctgatcctcactgggcaagtcgagactggttagttctttcaaaagggcatgcagggcctgcactgtatagcgctttagcagcgacgggatttattgactataaggttttggaaacattaaatcgcggtggaacgatacttccttcgcatcctgatcgaaacaaaacaccaggagttgacgcaacaactggttctcttggtcaaggtacatctcaagcagccggtattgcgactgggctgaaacagagaagattatcttcctacgtttacttgattgtaggcgacggcgaactaaatgaagggcaatgctgggaagcctttcagtatattgccagtaacaaactgaataattgtattgtgtttattgataataataaaaagcaactagatgggtggacagacgatattattcgtcaattcgacatttctgaaaagatgcgtgcatttggttttacaacgctacatgtcaatggaagcaatgtagaagaaattgatgccgctattgattacttgaagacaattaaagattcagcagtttgtgtcgttcttgatacagtaaaaggggcaggcgttaaatttttcgaggaaatggcagataatcactctgttaagttcaacaatcctcagatcaatgccaagactgatactgtactagaagaattaaagcaagtctttgaggaggaagaaaatgtttgaactagatgctaaaagagaaataggaaaagagttgcggcagacagttgtagatgcattggatacattgatggataatgacaatcaaatcattgcgcttgatgcagatttaggaggagccagcaactttcttaaattcaagcaaactcaccccgacaaattcatcgatgtaggtatctccgaagcgaatatgattggtgttgctgctggtctcagcttgacaggttataaaccatttgttcacacatttgcaccatttgttgcaagacgtgctttagatcaattatttgtatctggtgcgtactcaggaaatactattaatatctttggatcagatccaggatttgctgctggatttaacggaggcactcataccagttatggagatgtaggtattctccgaaccatcccgaatatagtcatttgtgacgctgcagatgaagtacaaatgaattggataattcaagctttcagtaaactgaaaggaatccattatgttcgggctaatcgaaagggcgtacgagcaatttataagaagaattcacaatttcgacttgggaaaggtaacttacttcaccgaggttctgattttctgatagtggcggcggggcagcttgtctcggaagcactggatgttgctgagaggttggagagtcaaggcatgtcagcagatgttatcgatatgtttacgataaagcctttagataaggacttgttattgcatagattaccacaaaagaaagctgttattacaatagaaaaccataatattattggcggcctgggtagcgcggtggcggaagtaatggcagaaaacaagatttcaataccgctaaagagaattggctgtgacgaccgctttgggcaggttggaacaccggactttctgcaatcagaatacggactaacctcggaaaaaatttataacagaattaagccacttctcgtcttggcagaaggtcatcgcgaagctgatttaattgccgtaaagcatattgataatctagaatagtagtttattcctttagatacggaagattagcatgtgtgcatgaacaaggattacttcaactttttgaggtgcagattggttgctataaaacttagaattttaagcaaataatgttcgaaatagttgaaacccctttcaccgtgatgtaggataatgttcgaggtcgaacatttcgtggaaggggtgtttttatgttaggcgctattgaagcaggcggaacaaaatttgtttgtgcagtgtcaccagatggtcaaaaagtagaacatagagaggaatttccgacactatcacccgaagagaccatggtaacggtatatcattattttgaacatcacccagtagaatcaattggcatcggctcttttggacctgtcgacatcaaaaagacatcaccaacttttggttacattgaggagacgccgaagcaatcctggcagcattttaattttttaggagaaatgcagcgacattttccgaaaattaaatttgcttttacaacggatgtaaatgcggcagcgtacggcgagtttaagaaaggtgcaggtcaaggcgtttctgaccttgtttactggactgttggtactggtattggagctggggttattttaaacggtcaaatactacaaggttatggtcatcccgaagctggacatattttagtgaaacgccactcagaagatagcttcatcggtgtttgtccatatcaccatgactgcttggaaggcctagcttcaggaccagcaatggagaagaggtacaacacatctgcaaagaatatttcagagaattctacagcttgggttatagaagcttattatcttgcacaggcatgtatgacgctcacattaactgtggcaccagagaaaatcatctttggaggaggtgttatgcatcagaagcaattaataccgttgatccaaaaagaatttaccgaacttttagctggctacgtgaaaacacctcctgtagatcagtatattacttctatacagttgcatgatgacgctggagttattgggggttttcagttagcaaaagacttgtaatggatgttaaaaaagcacacttcacaggggagtgtgcttttttatatcctcatgtgttcaagggtttcgcaacgacaacagagcaaagcttctttaagtctctgatgaatctgtcgctgagtttggaatcaacgatgattcctgaaagctcattaatatttgcaaacggatagggatcggccttgccaatctttgtagcatcggctacaacatacttttttaaggcacgtttagctgcgagttcttttattgttttatctggcaagctagaggttgttgcttggccattatagatgccattcgtaccaataaaggcgaaatcaaaataaaagttttctaatgcttgttctgctattgcccctagaaattggtttgacttttcttcgtatgtgccgccggctaagacaacttttgcttttcgttttaacagatctcggaatgctaaatcggaattggttacataaagaatctgtggatttgttggcagaaacgatattgccgcgtttacagtcgttcctgcaccaagataaacagttgccttgggtgttataaacgcagcaatctgtcttccgatttcaagctttgcttctcgttgaatcttagctttttcgttggttgtgcgttcaatgatcaatgaggcgccaccgtaagttcgtgaaagaagccttttttttgacatttctgctaggtcacgtctgatggtcattggggctacttggagttttcgagctaattcgactgttgtcatagatttactgtcggtctcccctaagagctcaagaattgcatcctgtcttgggactttcatgtcactccctcctatcctttctcatgttccaattatattttacctgtcaacgatgttcaagtatgttcatcttagctaaagaatattggatgaagcgagcatttgaaatttgcattttatatagtctaaagaaaaaagatctaaaattgttgacacaccgattgaaagcgtttactatgaacttgaacaaagacgaacacataaagtcgagatgaacatttgttgggaggagaaatcagcgtgaataccttcgatatttcaaaagtattgaatcaaaatctcatcactcttgatctaattgcctcaaataaggaagaagccatttccgagttaaccgacctcttggtagcagaaggtgcggtaaacgacaaaaaggcttttgttgaggatgttctcattcgggaaacggaaggaatgacaggcttaggtcaaggcgtagcaattccccatggaaaatctaaagctgtatccacaacttcactagctatcggtgtcagtaatcattttatagagtgggagagtttagacggaaaaccagttaataccattattttattcgcagttcgcgatcaagacgcagatacacttcatattaaattattacagaaagtggctatcttgttggcagatgatgagtttattgaagaactccacaaagcaaaaagtaaaaaacaagtattaacacttttcgaaagaaatccggaggaggaatgaaacaatgaagattgttgggatcgcggcttgcacatctggtattgcacacacgtatattgcgcgcgaaaaggtgttgaaagcagcaaaaaaattgggctgggaagcacacatggagacacaaggaactattggcactgaaaatcaactaacccctgagcaaataagtgaggctgattttgttcttttggcaatcgatatcaagattggcggacgtgaacgatttaaaggaaagagggttatcgaagtacccacaaatacagtgattaaagcgccaacgaaagtattagaaactattgcaaagaaacttgatgacaaacgtaattccactaactaattcttgaaaaggaggagcatcgtaatgattaagaagctccagttgcgtaaacatgcaatgaccgcaatttcgtatatgttgccactagttgttgctgctggtttattaatcgcaataggcaacctaactggcggaaaagtgatgacatccttcaagggtgactactttctaccatcagttctgacaacgcttggcgtgtggggtatgggattactggcacccgtcatttccgcagcaatcgcatattcaattgctgatcgaccgggtattgcgccaggtttactaagtggtgttatttcgtacaacattggtgcaggtttcttaggtggtatgttaggtggttttattactggctgggttgtcgcagctcttgtgaagtacatcaaagttcctgtttgggctgaagggcttaagccgatgatgatcattccgctattatcatcgttgattatggcaggcatcatgttttatgttgtgggtcaaccaattgtcgttgcgacaaatgcaatgacgagttttctcaatagtatgcaaggatcggcaaagtttgtcttcggtgggattatgggggcgatggccgcttttgatttcggtggaccagttaacaaagtcgcgtcactatttgcagatggacttttattacaaggcgttcaacaaccggaagcaataaaaattttagcttcgatggttccgccgtttggggtcacaatttcttgggtactggcgatattattcaaacgaaagatatataccaaagccgaagaagataatatcaagatagcctttcctatggggattgtcatgattactgaaggcgtcattcctatcgcagccgtagatttagttcgggttgttgcggcttcctccattggagcagctgttggaggcgcattatcaatgacttgggatattaaaagccctgtgccatctgggggaatgtttattgtacctgcgatgaataagccattgctattttgcttagcactccttattggttccattgttacgggattaattctctttttcaccaagaagacggtaacaaaagatgatgaggtgctggagtctggaaacggtgcaaatgaacctgaggaagagatcgatttagacgacattaagtttgacgaatagggggaccgttcatgtacgtatccatgaaagagatgctagataaagccaaccgagaaaaataccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgctacaattcaggcccttcaggctgctggtgacaccgcgaccgtgattgcacagaagcttcatcgcagtaaagcgacaatctcacgagaaatcacgcgtggatctgtaactcagctcgactcgaagcgtcactcgcatcaagtctatcttgcggaaactgcccaagccatgcacgaccgtaaacgcgatagaaccggtcactacgcctttcttaagaccggccgtgcgttcttcaaggctctcgccagggagcttactcgtaagccgcgcgtacacagcgttgatagcttcgtacacttctatcgcgaccagggcaaggcttgcccttcaacgacaactgtgtatcgctacatcgacgccgggctgcttgcgctagacaacatgacacttcccaagaagctccgacgccgcatcaaaggctataagaacgcccacaagcgcaagaataagaagatatacggcgactcaatcgagttgcgtcctgcggccgtgaatgaccgcacaggcgtgggacattgggaaggcgacttggtcaaaggtattcgcttagctgatgagccagcattaatgacgctcacagaacggtacagccggactgagatcatcgtcaagattcctgactatcatgcggacacctgccttaaagccttgcaggacacgatcgacgactacggggccaaggaatttgagagtatcacttttgacaatggttccgagtttgccaagttatcagagattgttggaacccagatttacttcgcacatccgtactcgccttgggagcgtggcacaaacgagaacgccaatggactgcttagggaattcttcccgaaagggaagtccctcagagcagttaccctggttgaaattcaagcagtccaatccgcactgaaccatcgtcccagacgtattctgaactatcttcgcccatgcgattactaccgatgcatggcgtaacagcctagaccactatcaagaattcgttatcatcgttgcacttgacttgaaaattgaggaaccgagaaaaatatgcggttatggcaataaactgtttcaatcttgagagcgcacacgctacgattgctgccgccgaaacaaaacgagcaccaatcatcattgacctgttgatggagcatatggaaaaacatctttcacgtgacgaactgcttccttcaattatcaacatggcagaaaaagcgagcgttgacgttgcattgaacttggatcatggaaagagcgaacagtatgtgattgatagcttaaacgcaggtatgctcagcgttatgatggatgcttcctcttatccgtttgatgaaaatgtgcgaatcacgaaagatgttgtcgagcttgctcataaaaagggcgcgactgtggaagctgaagtcggcaatatgggagctgtagctggatcaaactttactcaggaagatatgtatacaaaaccggatcaagcaatatctttcatcaaacagactaatgtggattgtttagccgtttccttcggttccagtcatggcactatgcctgtagggtatgaaccacactttgattttaatattgtcaagcggatcaaaaaagttaccggcaagcccttagttttgcatggagggtcgggatcgggaaacgagaatattagaaaatcaattgaagcaggcatcaacaagattaatgttggatccgatgtcatggatgcgcagtctgtagctatctttaaccaactggtagaagataagcactcggattttgttaatgttatgagcagctcaattattgcagcgaagaaggtggtagaagagtatatcgaattgtcggggtccgtagataaagccgctttgcaaacaatcacccagtaaacttgaggaggaatttcaaatatgcttatcaatatgaatcaaatgctgactgtagccaagaaaaaccattttgctgtaggggcatacaatgtatcaaacgctgagttattaaaggcttccgttgaacaatgtgaggctgacaatgctcccggaatcatcgctgttcatccgactgagttagcttacgcaaaagatgatttcttcgcttatgttctgcaacgtatccgaaatagtaatgttccattcgtacttcatcttgaccatggtgatactattgaaaatgttgaaagagcaattcatgacggctttagctcagtcatgatagatgggtctctggaggactgggagaaaaatgtcgcgattaccaaggaaactgtcaccatttgtcatcgccttggcgtttcggtagaaggtgaattaggtacaattggacaaactggtaatcatattaaggaacacttacaaaatggcatttatacgcaacctgatgatgctaagaaattcgtagaggagaccggagttgatactttggctgttggtattggaactgctcacggcatctatccctcagatgtcacgccaaagattcgtattgatatcttgaaggaaatcttggcagtagttgatgtgccgcttgtcttacatggcggatcctcaaatcctgatgatcagattgccgaagccgttaagactggtattgccaaagttaatatttcttctgattataagcatgcattctttgttcaggctcgtaaggttcttgcagaagatgatggctgggatcccaataatctcttcccaacagctattgaagcagctaagaaggttgttcatcacaaaaataaattatttgattctgtcgggaaagccagtctttacgctggcatgaaaccatggcgatcagagcttatctaattaaacaataaccagccattacccagatcgagaaggtctgggtttttatggtaatacatttaataatgcctcatttttgatgtgtctcggggcatgctgtggaatggttggtaaaggaaaggatgacttggccaataggaattatagtgcgtagctaaaaaccaagttgtctgtcaaaattaagattaagcacaatctgtctaaagtgttttcatacctttatggcacatgtggtatccactttataaggagtggcggtaagatcaaaagaaagttgtaatggaaaatagcagtcagatccagcgtcatacgctgctggagaagtagttggcaagctccgtggtgacaaccaaattggtaagaactcagtagcagatgttgttatcttcagtccgcaagcgggacgacaacaatatagcgggtctggtagtaaaaaagtgcttctcaaaatgagaagcactttttcagcatgaaaattaaagagcctatgcagataggaggttaatcttgtataggctcaaattatgggaaaacaaacgctggcttatttgtttaaaaggtctttgagttcaaccttgtcgttttgaggcatgatttgaatgaagacatgcacacccttatccatcagtcgcttaaaggtctcgttctctgcagaactagtggagattgtatggtataaccgttctctaccttgttttgctcccatgccgcctaaatcaatctcgtcgattgcaataccatgatctatcaaatactctaaagtttccggtacttttaccagaatgatcgttggcgcttcgagtggttcagagagaaacttaacgccatcttccttgtcaaaaacgccaatagccatagtttcgggaatcgcgttttcaagaacgttaatcataaagtcatcctttgcgacatcatcatcaatgacgagaacttgttcagcgtttgtgatccggctccatgcagtcattacctgtccatgaatgagacggtcgtcaattcttgttaagactaagttttgcacgtggattgccccctttttttaagtcaattagttcaactccagaattctgcgggtttagcgcaatttctgttaattgttgaagtgtagaagtttctgttcgtgatgtgataactgaaattaaaataggtatattcattcccgtaattaagttgaattggagtgtttgttttaaagacgctgcagtgttataaggagtgccgccctttaaatcaacaaacaccattgtttttcctgacaaagaggataaaagctcattcaccttacttcggtagttgtcggggctttctccttcgtgaagttgaattgcgtggattgctttttgtggtccggttatcatttctaaactctctaacagaccttcgcaaaatggaccatgacttagtaacacaatattgaccatagtaacctcctcggtgtttaggctttaacaattccaagtacatttaaataagatagaagtattccaacaacaaatattcctagaatgatccaagttgggttgactttcttacgaaccaaataccaaacgagcacagtgattcccagtgggattaatcctggggcaagctggttaagaatattttgcaacttcattgtgctcttgccaactgtccaaactaagggtgtccgaacagatacgcggctagctgccattgcaccaacgaccattaggccaacaatactgaatgcgttggtgactttactgattaatccattttttaagattgagataaccgattgcttacctttgcgataaccgaacataaacatgatataaccaatggtgtagataacgagttcgaaaatgagggtgaacataatggggccaagataatttccttgtaatgccaaggatgcgccaacacttgcaaggatagggaaaaagattccttgctggacggtatcacctatgcctgccgcgggacccatgagaccggttcgcactgagttaatatcgtctgcagaaacatcttgaccgttggcgcgagcctcttccatggagagtgcaacaccgtgaatgattggtcccaccatgtgcggttcggtgttaaagaagaccatgtatttttttagctcatctgcttggcgcgattttggataaagtttccgaattggatgaatcatcatattggtaaggccgagtgcttgaagccgttcatagttgtacgctgcttcatcgccttgctcccataaccatgttttaactaaatcagagtgtgttaattttttcgtatattgaatagtagcagggtcagatgagtttgctaccgaagtctctgaggctggcttgacttcttcggcagtaccatttcgattttgaagtgtaagccgacgcacttttttctttggagaagatgaatgagctgtttccttattagaacggctttgaccaataaacacaaggaatgcaatgcacgctgagaagatagcaattgccatgatatcgagctttaaatatacggtcaagaaaaagccgataataaagaaagcattgagttcttttttaccaagataattcagcaacattgcaatccccagtgctggcataagtccgccaacgacttcaagggcagttgtgaactgagcaggaattgcagaaattaatgatgttgtccatcctttgccaaacataaccagacaaaatgccggaatgccatatacgataaaagacacgatgaaggaaggtacatagtttaagaagcgaatttgattcacctttccttcatccaaggccttgtcggctcggtgaacccaaaatgagttgacagtttgataaatttggaccattaaaagtcctaagagtgagaatggaattgcgaacgtaacggctaatttagggttagctcctgataagattgttaaggctgacccatatataccagctaccattgtattgctcggcataacgccacctgcgttgatccagccaagataaactagctgaatatttgccccggctaacatgccaagcattgggtttcccatgaagataccaactaacaagcctgttgtcagtggataggtcatacatcgtgtaatcggagcaaaaaaccaccactgagaaataatcgcgagtaaggcaactaaaattgctgataatagcattgttaacccctccttttacgggaactgctatgtcggcgactataaaattgaaaagcctaatgcttttacgtcattatggaatcctttgactgtatcaagagataattctgtcggatccaatccaatcattttcatcttttcaagaattggattagtcacggtaataatatcgataccgaggttttcagcttggaagacatttagaagttctcttgaacttgcccataacagacttgcttggggatattgattgaccagggcctgactctgcttcattaaaggaactggatcgacaccagtatccgctaggcggccggcaaacaccgaaatgatattttgggtatctttagataatgcttcagcaacggatttaacctgtttgtaggttagaattgcggttgcattaatttggataccctcggtggaaagctttttaatgagtggaacagaggattcgcctttggtatttgtgattggaattttgacaaagacgttttgaccaagagttgccaacttttcagcttctttttgcattgttgtgaagtcgtcagcaaacacctcaaatgaaataggcagaccatcaacagctgccagtgcttctttagcaaaacttaaataatcagagactccggctcttttcattaaagttggattggtggtaaaaccgctaattggccatttggttttagcttcaatcattccgtcaactgaggcaccatctgcgtaaatagagatattaaagtcactcattttgaatccctccaagtttaattttgcggtaacgtttacgcaaagcccaaaaaattgagccgttctttgcggcaactttgaaagtacatgacattgataaggtcacttgaatttggtattattgtgtaaacgttttcgcacctttcagatattattaaacaacgatacctgtgaaaagtcaaacaaaaaacttggtgatcttaatggcaaacaaaaaaaacgcttcaattaaagatgtcgcaaggttaagtggtgtctcagttgcaactgtttcaagaattatgaacgacaccggtagatattctcccaaaactcgagacaaagtgcttaaggttattgaggagattggatacgaacgcaactccttggcaacgagtctacggatcaataaatctaatatgattggtatcttggttccggatattgccaatgagttttatgcctcagtattaaaaaagtcagagcaggctctttttaaacttgggtactctacgataatctgcaatactgaacgaagcattgagagagagacagcttactatcgaatgctaattgaacatcgcgttgatggccttatctcagtttcaagtgccagtaaccaaatgccattatctgcaaagtatgctattccaattgtttttatcgaccgtgatccacactcgaattcagagctaattgtgactactaaccactatgcagctgggaaagagttggctaaacttctgcttaatcaagcggacgatttatgccttgtcatgacaaaatcacgtccatcctcaactatggatcgagttcaggcatttaaagacgaactggcaaagagcaaaatggacacatcaggaaggatcttgtcgttaaatacaacatctgataagtttttacaacctcatcctgacctaaaggagtttattgagaagaagtgtcataaaggcaaaaggctgggtgtgtttgcaattaacgacaacgtagcctatatggtattaagagttgctgatgaactgggtcttaaagtgcctgatgaactaattgtgacgggggttgatggtatgtccattgcatcgatttcccaacctacaattaccaccattgttcaagattcaacggcgattgctgatgaagccagtcgtctactagttgagtcaataaagaagaggggggaaaaagaacgattatcaggtactatttacattccttatcgacttgcacagagaaagagcacactaccaaaaaaataaaatccagctgaaataccgttacaagttatttgaagattggtgttgcttttttgtctgcgtacgtgtgcatatttgaaatcaaggcattgggatcctaacgcgcacattcatcacctcggaagttacttcctctataaaaaagttagaatactttgttgactctaaatgtgcaagggcttacaatattgttgtgaatcgaatatacagaaaaaaatatattcctctaggagcgccagaaatgaagacttatcaatatcaaaaaaagggcttagcactcatctttttagcgaagaaattctttgtcttgaaggttggtgatcgtattccaacagtctccgaaatgatcagtgagtccgaattatcaagaggtacgattcaagcgggacttgaattgatgaaagcagatggcgctatttcaacggtttcgaagggacatcttggttcttttttagtggctcaagatcaagataaacttttggcatatttggattatcggaatgttgtatgtgctatgccacttccatataccaaacactatgaaggtttagggacaggtctttataaggcgtttaaaaatcaaaagctgggattgaatgttgcttatgttaatggttctgtgaatcgtttagaagggttgcaacgtaatcgttacgacttcatcattgtatctgcgctcactgccgattatttgactgaacatcatgatgttgatgttgttggaattatgcctgagggttcatatgtatcacgacacgtcattgtttataaggacgatagaaagttcaaaatgcgggatggacttcgtatcggtattgattcacattcgctagattataagttaatgacgaacaagatcttggagaagcataaagtcgagttgattgagtcgccgtataatcagattgttcaaagaatagtggcgggtgagattgatgcggctatttggaatcttgatgaagtgaagtcaaagaattatccgttgagttatcagatgattaaagatccaatggtaaagcgggcatcaagagccgctattctctgcgcaaaggaaaatgaatttgttaaaagagtgattggtgattacgtggactttaaggaagtgacagccattcaacaacaagtgatttcaggagaggttttaccagaatactaactaagttatattctacgaggaggtgagacaatgtgagcgatgaaactgctaaaaagctgcagattttatatgatgttggcaagctgagtgatgaggatcttgcatttattcgtttagctgatcaatatctggttaggacagtgggcgagagagactccgagatgttcttaattcatctatcaattgcattggaacgcagtcacaagcaagaacctgtggatgcattgccggataacttatgggcggaagtaacagctgatccagaatacctgaacgctttgaatatctggaaacacattgcagaatctcgaccagttaatttttcagattttgaaacacgctatattatcatgcatttggttaatatcctgaggaggggttaacatgacaagaattgtcattggtggtcagatgggaaaagaagagttgaggcaggaacttgagaagctgactgccgggaaagatgttgagattagtgttaagagcgatcttgatgctgctatggcggtaaaagataataaagcagacttttacattggtgcttgcgaaaccggagccggtggcgcattagcaatggcaactgccttattaggatcaagcaagacgctcacagttgcatcaccctcaaaggttttgtctgaagaagatatcaaagagggcattgataatgggaaggttgcatttggttttacaattaatacaaaggacacaattttaccaattcttgcaaagtatctgacaaagtaagcttttatgccataaatcaatatactgtattctgtatattgagaaaaggagggtgtcaaaatgaacgtttcggtcttaatagactacgtgttaattgcgctagtcggaggcgtgggctctatcttagccaatcgcggaattgcagtctttaatgatggtttgcgaccaattatgccagagtatttggaaggtaagattgatcgcaaagaattggctgccaccagttttgccgtcagttttgggttaattatcggctttgggattcctgtgtctattggttcaacaatcttggtggctcatagtattttgctcgctgccgatattattggtacatggacaccagctaacaaatggggaactgcattagcgggcgtggttggtgccgtttacggtgttggtcttttgttcgggctatcatttattgtttcagcgtttaagatgctgccggttaacttcttaggagcgctgtcactgttaggtggaccgattctattagccttctgtgcgtttccagcactagccgttgcaagtcagcatggggcaaagaaaggcatgatcacatttggagcgacatttgttgcttaccttcttgctacaaaatttggggtattctcacttggtaatggtatcaaaattactttaaatccaattgggatgtcactcttagtagcaatgttgttcatgctttactttgctgctcaaattaaaggcgagggcacttcaaatgcaagtctcgtaaacgtcttttcagcgcgtgtttctcgaattaaaaagaattggatttggttgtccatcatgggtggcttaatcactgctgcatcaagtgtcctgattattgcggttgatgttttgccacaacagttgttggttaaaggacaagttatggaagctgccattgcaacattggctcgggcaattggatttattccgctggtcttctctactgccattgtaactggtgtctatggcatggctggtactacgattatctttgctattggacttttactgaaaggtaatccgattgttgcgtttatcgcgggatttgtttggatgtggattgaagtacaagcgcttgctggtactgctaaaggtttggataaatttcctgggttgcgcgatatgggtgagcatattcgaacttctctcactgatacgattgccatcgccttgctgattggtgctgcattagcctgcaataagatggctcccaaccttggctacttttgggtgattggggtctggctgctgaacaagaagctgaaaaagcctcttgttgatatggctgtgggtccaattgctgctatcgcactgggaattttattaaatctgttacgaatcgtacatctgttttagctgatgacgaacggattaagggaggaaatatgttattaccaggtaaagtctatgctcatgaacacattccaattgacttgtctgaagtcaagcaaaatgaggattgtcatctagataccattaatcaagtgattgcggaattcaaagatctttatcaaaaaggcgtgcgcaatgttattagtatgacaaacaagggtatgggtcgaaatataccgtatgccaataaagtagcaaaagaatctggcatcaacattgtgcaatgtaccggtttctatcaggatgcttttttgccaattgaagtttttcgattatctgttagtcagttagccgagcaaatgatcaaagacattgaggtcggtataaaaggcactgatgttaaggctggtgtgattggtgaaattgcaacgtcaaagggtcaatggacagcggccgaggaaaaagttttccaagctgcagttatcgcccaaaaagaaacgggttgtccgatcagcacacatacctcaattggaaccttgggtcatgaacaagtagctttctttaaaagacatcaagcagatctgagtcatattgttatcggacatgttgatctgacgggtagtgctgattatgtcttagagatgctaaagacgggcgttaacgttgagtttgacacgattggaaagaataattatatgcctgatgcaacacgagttgagatgttaaagaaaattgagaaggcaggatttatggaccaagtcgttttgtctatggacattacacgcaagtctcatttgaaagtaaatggcggaaatggatatgcctatttactggattcgtttattccacagttgaagagagcaggtatttctgaaacctttatcaacaaaatgttagaggaaaatccacagagaatctacggtgatatcaatgcctaagtttaaaacttatcccttggaaagcataggttacgaagaagcgttacaaaagcaatttagcttggtggatgaaatcacacgacaattcaagggttccgaaattctaatgcgcggtgacttgggtgttgtgcgtggccttaatcgacctcggtatacagaaaaagtagaaaaagttcttgctgcttatttccacgcggaatctgcaatgctagtccgaggcgcaggaacggctgcaattcgcatggcgttgcacagttatctgaaaactggtcaaactttattaattcacgatgctccagtgtatccaaccacgcaaacgtcaattgacatgatggggctgaaaactattcgggttgatttcaatgatttaagcaatcaggacttacctgagaaaccagatggcattcttgttcaatacacacgacaaaaacctgatgattcgtatgatatgggggaagtcttggcgttctttaaggagagatatccttctgtgccaatcattacggacgataattacgctgttatgaaagtccgaaagattggcgtcgaacttggtgctaatttaagctgcttttcaacattcaaattgttagggcctgaagggattggctgtattgttggcacaaaatccgcgatagagaaattgcggtctgaaaattattcaggtggttcacaagtacaaggacacgaggcaattgatgttttgcgtgggttaacttatgcacctgttgagttggctattcaagccaaggttgtgactgagctagttaatcgactgaatgctgacgaggttcctggaatcttaaaggcatacgtggcgaatgctcagtcaaaagtcttgttagtggagtttgacaaaccaattgctgaggacgttttgaagtatacggaagaatttggtgcagcgccaaatcctgtgggggctgagtcaaagtatgaaattgtgccaatgttttatcgtgtatcgggtacgtttaagagattcgatcccactcttctgacaacgacaattcggataaatccatatcgttgtggagcagataccgtcattagaattttaaagctaagcgtagagaaggtgatggaatcatgttcttaaagcagttggaaaaacaaaatcccgaattgattcggtatgcgtttgaattgcataacacaggtagaattcttccggatacgtatgtgattgacttggacatgatctttcaaaataccgaacacattgttgctgaggctaaagaaaatcacgttgagttgctttatatgacaaagcaggttggccgaaacccggtgattgcaaaagaagttgtaaaggctggtattccagaagcagttgtggttgattttcgagaagccgagacttttatggaaaatggattagctataggaaatgtggggcacttggtccaaccacccaagcattttctaacacggcttctgagatatggaacacgatatgtaactatgtattcgcttgagaatgtcctggcgttgaatgaagctgcaaaagcagtaggtataagacaaaaagtacttttgaaggttgtgggtaatggtgatgatatttatccaggacagacaggcggttttacattatcacaattagatcaacaactggaacagatcaaggcacttacaaacattgaaatttcaggtgttactacattccctgcaattctatacagtgaatcaaagaaagatttcactgcgacaccaaatgtcaggacagttaagaaagctaaagagatttttgagaaccacaatctaagcacgactgttgtaagtttaccgtctgcaacatcgacaacttcactgccgttaattagacaattgggagggaatgaaggagagcctgggcatgcattaacaggaacaacacctttgcatgcggttaaggcccaaccagaaaaaccagcttactgttatgtgagcgaagtttctcatacgtttggaccgcatagttatatctttggtggcggattgtatcggcgtggtcatctaaaaaatgccttagttcaggatggtaatcagtatgcacatgcccatgttttacctcttgaaaactcaagtattgattattatttagagttggaccggcagtttaagtcaggtttgcctgtaataatggcgtttcggacacagatttttgtcacaagaagtactgtagcactggttcgaggattacacacagctggtaaatcgccagagttggtcgggttgtatgacagccaaggaaaaaaattaccagaaaggatgcaatgacatgggaaaatttggtgttattgttttagatagttttggcgttggcgctatggatgatgttcctcaagttcgaccggatgacatcggttcaaatactgctttgaacattataaaagcagtaccacagattaaaattcctaatctagagaaacttggattaatgaatgccattggtcaggaacgtggtgatcacaagttttctcctacagctaactggggaacttccttactgatgcaccatggcgctgattcttatcttgcacaccaagaaattatgggtacaaagcctaagatgccactgcttcagccgttcaatgaagtgatcgacacagttgaagcacaggttaagaaagatggattcgatgtcgagcgttacggtgatcccgggtaccagttattggtcgttaatcattgtgcgacaattggggataatcttgaagcagatcctggacaagtttataacgtaactgcggcacttgatgaaatgccatttgacgaaattacacgtttgggagaatcagttcgtagtgtggttaaagtctcgcgggtcattgcatttggtggccgaggcgtagatttgaacaatattttggcagctcggaagattgaacacgagaagtatgtcggtgtttcagccccggaatctggcgtttacaacacagattaccatgttattcacttaggttatggcattaatcctaaggtacaacttccttcaattcttcaagcaaatggtattgacgttgccttggttggtaagacagcagatatcattaatgttgatacaacgcggaagttcccaggtgttgatacgaactatctttttgataagtttgttgagcagtcgaaggatatgaaagatggccttttgtttatgaacatccaagaaaccgatttggcaggtcacgctgaagatcctgttcgatacgctgaagtacttgagacagctgataaacgattaactgatgttttaccgttatatacgggtgacgatattttaatagtcatggcggatcatggtgatgatccaacgattggatttagtctgcatacgcgggaacgaaccccgctgttaatttacaaagaaggaacccacaataaatatgttggggagcgctcaacgctttctgatgttggagcaaccggatcagattattttgatgttcagtttccagaaaatgggaagagcttcttgcatcgcataatcgatggaacggatttagacgcttagttatgtcagtagcaaatgctggtcttgtgagatcgccatttgctatttttatttgtctcgatgaaaacgtggataattattgtcgaataaagtaattcgtgcaggtacttttaactggctggtcatgaaaaagaacggtacgaagctctggattgtgaaatgaattgtactttcaatctttacacccgaacatttctcagctaaactctgattacattcagtttccacagaactcacaaacaagtaccaaaactgaacgaaacacagcagcatctcccaacgaacaattggtctgaggatgctgctgagaatacaggaggcgagtagatggcaaagttagtgttgcagacagatttcggattggtggatggtgctgttgcggcgatgtatggggtggcttatggtgttgatgataagctgtcgattcatgatttgacgcatgagattccaccgtatgacatttttgcggcgtcttatcggttgtatcagacgacgaagtattggccagcgggaacggtttttgtttcggtggttgatccgggggttggcagtgatcgacggagtattattgcggagacggcggaccatcattttgtgattacaccggataatgggacgttgacgcatttggcgaagtttgttggtttgaagcgggtgagtgtgattgatgaggcggcgcatgcgttgcctggcagtcaggagagtcacacgtttcatggtcgggatatttatgcgtataatggcgcaaagttggcgagtggccagattacgtttgaggatctagggacgccgcttgctgctgatcagattgtgatgttgccgctgggcgaagtgacgcagcaggaaggccaaattgccgggacgatcgatattttggatattcggtttggttcgttgtggacgaatattccgctggatgcgtttaagaagcttggcgtggcgccaggcgagttggtgcaagtgtcgatttattatcgtgaccagatgcggtatcaaaatcagatgccgtttacgcggacgtttgcggcggtgcgagttggcgagccgctggtgtatgtgaattcattgctgaaccttggcgtggcgattaatcaggattcattttcgaagttgtatcatattggtactggcgttgattggcatatcactgttaagcggctttaggtataatgaattcattatgaaaatgttgcgtcagctaatcattcgttgacgttgtggcacgaatgatacgaggaggatttttatgcgagatcacaaagttttgagtgtccgaacggttgttgcaatcgggattggcactgcaattttatttattttaaagcgctttgccgttattccaactgggattgctaacacgaatatcgatatttcttatggtttcttgggctttattgcaacgctgtttggaccgatcgccggcttctttatcggttttctcggccatgcactgaatgactttactcaatacggtcagccttggtggacatgggttttcactaccggtttggttggctttgtgattgggctattttggcggcggtttaacgttgaagccggcaattttggtgcgaaaaaaattgtggcgtttaacgttttgcaggtgattacgaatgtggttagctggagtctgattgcaccgacgctggatattatcatctatagcgaaccggctaataaggtttatgttcaggggattgtttcggcaatttccaatagcatcgcaactggtgtgatcgggacgattttgttggtggcgtatgcagcaacgcggacacgttctggcagtttgaagaaagagtcttaatatggcggcaccagcaattcaacttgatcatgtgacatttcaatatgacagtcaggctgaaccgaccttacacgatattaacctgacaattcagccaggcgaaaaagtcttgattgtcgggccatccgggtcaggcaaatccacactaggcaacctgattaacgggctgattccacatgcatttcccgggaaattaagcgggacagtgaaggtgaacgggaatgttgtgcaggatcagagtctggctgcgttgtcgctgaatgtcggaacggtgttgcaggacccagatgcccaatttgtcgcgttgacagccggcgaagatattgcctttgcattggaaaacagcgccgtggctccgagtgagatgcacaccagagttaaaaagtgggccgagcgtctgaaaattggtgatttattggcgcaggcaccgcaatcactttctggcgggcaaaagcagcgggtggcaatggccggcgtcttaattgatgaaggcgacattttattgtttgatgaaccgttggcgagcctggatccggcaaccggtgaagcatcagtggcgttaattgatgaactgcatcaaacctatcatgtcacagaggttatcatcgagcatcgactggaagacgtgttgcggcggccggttgatcgcgtggtggtgatggcagatggccgtattctcgctgacgacaccccggaagtattgttgcgtggccagttgctccaaaaaatcggattacgcgagccgttgtatcttgaagcagctgagtttgcaggtattgatttgaagcaggcaacgcacttggcaaaccttgaaacattcgacgccccggatttaggcaccaaacttgcagcgtttaccactgaggcgccgaaaacggtcgccgatcagacgcaaacaccgctgttgacggttgccggcttacaatttgcgtatccaaaaggccgccagattttcaccgatttgaacttaacgctgcatcatggcgagatggtggcgttggtgggacgcaatggtgtcggcaagtccaccttgagccatttgattgcaggttttctgaatccgaatgccggccagattacgctggatggcgaggatttggccacatggtcggttaaagagcgggcagataagattggctatattctgcaggatccgaaccagatgattagcaagcatttgatttttgatgaagttgcactgggaccgcggttacgtggttgggatgaagaccgcgtcaaatcggcagtgctatcggcgcttaaagtttgcggtttgtatccattccgttcctggccgattaacgcactgagttacggtcaaaagaagcgggtgacgattgcagcaattttggtactagagccggcattgatgattcttgatgaaccgactgccggtcaggattggcggcattttaccgatatgatgcgctttttgaccaagttgaatgatcaaggcattacgatgatgttgattacccatgatatgcacctgatgttggaatatgcgcagcgggcgattgtgcttggcgatggcggcgtcttgatggatgccacgccggccgcggtgttgaccaacccggacgtgattcaacacgcctcgctggcccaacccagcctatatcgcttagccaaacgcctaaatcttgacccactggcgtttacccaagcagtgattgatcaggaacggagggtgcgccaatgaattcactttttggatacgaccctcaagacacgtggctgcaccgtttgaccggagcaactaaaatgttggcgttcattggcatttcggttattgtcatggccagttacgacacacgcttcgtttgcgcagtcatgctggcatcaattattttattcttacaagcaaaaattcactggcaccaaattagcttggttatcaaaattattaccatttttgcggtcgtgaacctattactggtttatgtcttctcgccgcaatacggggtggggctctatggaagcaaacatgttttgatccatgccggctacctgaccctgactcaggaacagctattttatgaactgaatctcgctctaaaatacattgtgaccgtcccgctggccttaatcttcttaatcaccaccaatcccagcgagtttgcggcgagtctcaataagttacacgtgtcgtatcgcatcagctactcggtggccttggcactgcggtacattcccgatgtccaagccaacttccgccaaatcagcctagcccagcaagcgcgtggctatgaattatcgcgtaaagccaagctgttccaacggttgaaagggatggggcagattctcatgccactgatcttcacaagtctggatcgcatcgatcaaatcagccaagccatggaactgcggcgctttggtactggtaagcgtcggacgtggtacatggaccagccgctaagaacaccggattggttggtgctgggcggcgttgtggcgattattgtggttggattggtgctgtttcgggttaatggcgggcggttttttaatccgtttaaaggctaactttttaactgaatcaggtaatagtgcaggcagtcatcgcgttatttggcgcggggatgcctgcattttacttcttgatccaaatgcaaacggctggcaatctcagaaaaaacgatacgcaacacaataaaaaggtcgttgcacgtgaacacacaacggccgaatgtagtaccaacttaatagtggcacacagaacgatgcaactaaaagccgcagcataccagtggaggatgccgcggctttttattcgtctttttctcaagataattccagagcctgtatgtgcagatgaacatatacaggctctggaatttaactaatcacgtacacacagtaacccgaacgacaaatctacacgtgcgcggtagcctttgccgttaaagtcttagtggcaatggtgaagtcattcaaattctcttgatcaattgcaacacccatgccgggtttcgctggaacattcacataggtaccgttaagtgtgatcagtggtgtgataatatctcggtcatagtaacgtgtcgaggctgcgatatcgtttggcaaagtatagccaggtaatgtggcgattgcaacattttccgcacgggcaacaccagaatctaacatgccgccgcaccaacatttaattccgttttgagcggccaatgcttggatttgttttgcaaccgtcaagccaccaacccgtgctactttgatgttgatgattttaccgctgcctaaacgaatcattttgcgtgtatcgtctaagctcgtcacactctcgtcaaggcagacaggggttttaatcagcttttgtaggtcagcatggtcaagtaagtcgccgggttcaagtggttgttcaatcataataaggttgagatcgtcgaggcgtttaagcgcggcgaaatctgctcggcgatatgcggagttggcatcgcccatcaacatgacgtttgggaatgccttacgaacagctgcgagatagtcgtaatctttaccgggctttattttgcatttaatgcggcggtatccttgttcaatgtagccattcacaactttaacgagtgcttgcggtgaggcttgaacgccaattgagacgccggtttcgactttttgcttgtcaccaccaagtgcagtagcgagcggcagattagcttgcttggcaaaaatatcccaaagtgcgcaattgatggctgatttagacatgttgttgcggcgaattcctgctaccagtggatacatatcatttggatggggaatatcaacgttaagaatcatcggcagcataatattaagaagtaattcccaagcaccggcgcgaaattcctcattataaaatggaatatcgaaagcggaaacttcaccgtaaccttttgtgccgctttcatcggtcagctcaagaatcatcgtctttttggcggtcattcgtgtaaaactggtttcaaaaggatggcgtaaaggaatatcaacttgacgtaacgtagcagaaataatcctagattgcataattaaagttaccacccagaaaatgtgaaaaaagacctgtccttctttctaaatggcttgctatgcaaacaccattttagcaaaaaagggcagattttttcgtttttggctaatggtagctctcaatatgggtatataccaataagcggtgtgctttaattttattattacaaagtatcgatacaggtggaaagctccttattagaattaaaattaagggtataccagtttaagacagcgaaaaataatttttttattgactatattatataaatgcgtttacaattgaatgtgtaatcgcttttaaaattcattttagcaacgcgtataaagctatttttttattgctagactttaaacgaccgttcgtaaattctaagcatgtgagcttttatacttaaatggtaaagaaaattggagtctcgtatttttttgtcagtgcttaactacgggaatatccatttaaaaatgattaccagtcactaacgacgttggaattaatcgacttcgagcaaagcaatgggaggtgagaatttttgaagcttcgtgcaaagactatcgtaaacaaatacgttgaaggtttcaggcttcttgttacaatgacggcgtaaatggaatcgggaaggaatttcaaaagttttttatcaattactgtagttcttgaacacgatgacgtttgtactgctcaacattcactaaatagaaatggggaccagaaatgaaaaagctgacaaggattattttttgcgttattagttgtgttagcctaatagccagttcaataggactctattcaactccaaaaatcgtaaaagctgatactacatcagtgaccgatgccgatattaatgcctatatttctaatatgaccttagatcaaaagattggacaaatgtttgtgtctcgaacattgcaagatacggataaagctcgatctgatatagcaaaatacaaccttggtgggttgattgtatatggagctgatttcactagtgttgaaggaaaaacagctaccgaagcacagaataatttcaagatgaaggtgcaaagttttcaaaactcagcaagcctgccgttattgattggtgttgatcaagagggaggaacagtttcacgcttatcacaaaatcctctaattgcgaatggtagaagctttccttcaccacaaacggcttatgctaatggcggaatggccaatgtaacaaaagaggctagtgaagtcggaactattctaaaaaatctgggcatcaattggaactatgcaccagtagctgacagcacgcctgatacttctagttttatttatggcagaacttttggtcaagattacttggcaactgcaaactatattacgaatgtgatccctgcatggcagaatgctggtgttgcagcaacgcttaaacattttccgggttacggatcagcgattgatacgcatacggattttgcagttgttacaaaatctaaggcggattttgaaaaagaggatttgcttccctttaaatccggtattacagcaggagcagattcagtaatgattgcacatatcgtaatgcaagctgttgacccagtatacccagcttcattatcacgaaaggtcgttacagacttgttgcgtaatgaacttggttataatggcttaatcattaccgatgcattggaaatgggagctatcaagcaatttgctcaagaacatgatcaagttcctgttgatgttcttgctgttgaagcaggaaatgattgcatcatgaataatgattatgaaaccgctattccacagattcatgcagcagtaactagcggcactattaaggaatcagaaatcaatgaacacgttttccgcattctagatctcaaacgcaagttagggctgttaactaaagcgcaacttcagcaaaaaaaggttcagattgacaatgtttcctacagcagtgacaacaaaaaggcaacagttagcggcacagttgttgatagtgattggcaagttggagaaccgttatcggttaaagactcaactggaaaggtcattattaccgcagacgtcggggccggtggtaagtttactttcgatattcctactaattcccaagaacaagtattaactctgaccactaatctacccaatatcgctgatgccaaaataactattaaggctgtgagttcatcgaatactaacaaaactttgctagaaaacttgattaaatctgttgaaaaattagctagcaatcaatatactgtcaagtcttggcaagagttgcaagctaaactaactgaatcaaaatcaattttaaacaatgatagtgctacacaagatcaagtagatgcttccgttaatgctttgcaaagtgcccttaagcaattagtttctgcatcaaatagcgaaaataatagtcaaaactctaatgatagcagttcccaaagttcatctaacactggtggacaagcatcatccagtactagtaatgctaatgagactaatattgctagtaaggatttgtcaggtacaaagtcggataaaggatctaaggacaatcacggttttttgccaagtacgggtgaacgcgtgatggcaggaatttctgttctgggggtaattttaatagcttgcgtgactgtattatatattcgaaaaaaaagggcataacttctaattattgattagtaaaactcattagaggccgccagaactcacttggttctggcagtctttttttggctttacgtcaactggtgttgaagcataaatttatctttgaggcggttctccatttggggagccgtctttgtcatgttatgccgtgatttggtagattcgtttgaagaagttcagctgatttttgaagccaaaacaggatcgtttgagtgacttgatgaggcggttaaccccttcgatcggaccgttggaataagagctggtgacagcggcgagaacagcgactttgtgtcgcttaaacgttgtccattgccgtaccctttggctcgtaagtagctaacaggtttgccagttccgcgggatgtttcttcaccatcaaagcatcatgaagcgctaagtaggtctcatagggttgcttgagcttgggctcagtatcaagtcctagattgcaataataaagttaccacctagaaagaggcttgctcactgcttgaactggggtttgccaacgaagacattttctaggtttgttattgataaacgctgtggctcgttgaatattggcctctgaaacctgatcaaactgtgttcccttcgggaaatagtagcgaagttctcgattgaaccgttcgttcgtgccccgttcattcgggtgataggcatggcaaaagtaaaccggtatccgatagcgctttgtaagcgcctgatcgcaggaaaactctttaccgtgatcaaccgtcactgatcgaaccggacccggaaagtctaccatcagtcttgcaaaacccttgagaacagcatttcgtgataagttttcaagcttagttgtcgccattaaacgtgtgacccgatcgacaatggtcaaaacagcagcctttgacccgcgaactgtatccatctctaaatgtcctttttcggttcgccgattagctgactcactgcaaatctcaattgaggtgcctactgcttggttatagcgcgaccgaaggtcttgtcttcttttatgacgtttaccgtgatcaaagagttgacttggctgaaaatcgacttgtctttgataaatccagtggtaaatcgtgtgtggtgcacagtgaacggcataaccgaccatttcaggggaccaacctagggttagcctctcagttaccatccgcttcaacttaggcgttaaaatcgagtgccgaccacaacgatgccgacaagtatcggcatgatcctgagctataatggcgcagtaatcgccttcagggcaacggtgaagctcatgcctaatagaaatacgagagcggcctaaggtcgcggcgatgtattgaatcgtgtggtgttgcatcagttctatctgagatcgttcaattaaggttataatggccatgggacctgtccttctctctagatggtatgttatgcaaacaccattttagcaagaacggacaggtcttttttcacattttctgggtggtaactttaattatgcaatctaggcatcttttcatctttatctgcgaccctatttaggagatcagacagattcttacgaagatttgtcggtgtatatatctccattggaattcctccctgtatatatgtacatcatagcgcacgccaatgataatcacgtttcgtctttaatttcgatagggtgtaccctattgtaactaatacgaatggagagtattattagttacatataagtgacccggaggtgatctagaattgtctaaaatcggttatgcgcgtgttagtacgcgtgatcaaaatctggcgcgtcaaattgaacagctacatgatgccggtgttaataaaatctttcaagagaagctttcaggtaaaaatgccgatcgtcctcaactgaaagcaatgttagactatattcgtgatgatgatgaagtagtggtactgagccttgatcgacttggtcgcaattctcatgatttgactgacatcatcgaaaccattcggcatcgtggagctcaattgaacgttctaaatctacctagctttgcaagtattgaagatcctaaccttcgtaacttgattacgacaattattgtcgaactatataagtatattgctcaagaagagcgcgaaactattaagatacggcaacaacaaggcatagaaattgccaaacgccagggcaaatataaaggcaaaattcgcgaatatggtcctcattcacctaatcgtcaaaaacgctatatttataaagaagcctgtcgccttttaaataggaagaaagacggagatgaaactctgaccaagcgacaaattgcccgcatgttaggtattgcaccagtaaccttatatcgcatcgaaaagtatcaggcagaagatctagcaaatgttcctcgtagtgagaggtaaacatcatgatagatttaaggggcaaacgaattctctttaccggccgtttgcgatcttttcgtcgtttccaggcacaacagttagcaactattctaggagcaaaacctgtcaacgggattgacaaaaatgttgatatccttgtggttggtattattagcaaaccctatgatcaactacttaccactcaaaagttaacgtatgctagaacctatggcattccaaagattgacgaattagcctttatttcatggtgccaatggcgattagatcaattgaaagcaactctttaagtgccttcttatcaaacggggggaatagtatgcaaaagcgtatcgatttggccaatcaaacgtttggacgactcacagtcattagtttttttggaagcagttctaatggcaacgcgctttggctctgtcaatgtcaatgtggaaataaatgtattgttgacagtcaacgacttcaaaaaggattcactcgcagttgtgggtgtttgcgatcagaaataagcagattaaacataaaagctaataaccagactaaaaaatacatgggcaatcccaagaattttcaactaatcaatcgaacaaatttagttgcttctacacttaaacggtccaataacaaatctggcgttatcggagttagttgggataaaactgctcaaaattgggtcgcaaggctgtactttcaaggccatcttgtcctaaatcatgtatatgttcatatggaggatgccatcgctgctcgcaaggcagcagagaaaaggtatattgtacctttgcaaaagcaatataatcaaacacaccaaaaaaaatcaattaaattgattagacaatccgatctggagaaaatgccattacctgcactttctatagatttatagaaaagccgattcattataaaatggttcaattccgtaatcatgcaactgccctaaatactaagatcagtttgcaagaaaagaagccgtagcgtgtgtttgtggcatcaagacttaattcgacaaactcccaggacaacaattattgggacagcgtcgtgaaatggaaaaacgaggttatcatctagatcagaaacagtgtgatcctctgtatcaaggccaacattgcctagcatacaagcaactaagtcctgttgcactcacaatgcccatctatcctgagtatgaccaaggatataaacacgtttgcctaactaatctaacaagcaaaaggatcttgttaacctttcagcgatcctagtctgcggtgttcatctggggacataggattgacaaaataggatattgacaaaacagaatatcggcaatatacttactaaaagtaattggaaagcgtaatgtcgtgttgatcggagaaaattaaatggtaaatcttacagaagaaatgaagaatatgttaaagagtcagctccccttcctagcaacaacaggaatagatggcaaacctcaagttggtcccaagggctcactacatgtcttagatgactcacatttaatctactttgagcataccttcaggcaagcctatgataatctctcgagcaaccatttggcagcgtttgcggttgctgatagaggcgctcaacagggatttcgctttgagggaacggctcatattcatgaaacagatgattttgctaatcatattttagatcaaactaacatttttgaccgttttccacgcgctggcgtagtggttattgatgttgaacgaatctataaattggataacaccttagaggctggcattcaaatcgcctagggttcttaaaacaaattcaaccgagtaagtcgaagaattttttagtgtccaaactcatacagtgcttatttcatgtcattaagtattcattagcaagcagttttgttatactttgtttagaagtgatggaagtacgtcgaattcttaagaaaccatagcctactgttaatgccattacttagagcgtgtcgatttttgacacgctttttttgtgccattgggtacaaatcatccaataaaaattaaatatcaaaaaagacggcttccactatggaaagtcatctttgatgaaccggttttctaatactcattcatgttgcatcgtcctacttcaaaagcttgaaatatacagacatagtgttttaataagttggtcgtttttagtttattaaactcaatatcagtcttaaaatattgatcctttcctcatttaaattaacccaaaaggatattaaacaaattttaagatcttaatgatattcttttaattgaaagcttttatcccgaatttttttgacataagccttgtacttagtccggccaagcggtgtgacaattgcgactcgataatgattaccaggcaggctgatgtcagtcaccccagtttgatctgatttaaaagaatgtatatgtcgacctcgtttcaccacgacttgtgtggcttcagccggtacttccagcaaataatgctttcggccaagcatcaaactgcgcattacgaaaccgatcacgcctaaaatgatcaccgcgcctaaaagtgcgactattagctttaatttgttccaccaaaccgcccaacttgaagcctcttcatctgccttaacgtaaggaattcggcgacccgttatcaacaatcgatgagaattgatcatataaggcgtgcaggtcattaaggtcacaagatcctgtcccggcacaattcttagctgccgggtatcacttggctcaataacctggcgcttaaagacttggtaagccaatttatgattgcctatgctaataaaaaacttgtcgcctttttttaacgctggtactcgggtaaaaagttcagcgtttggcacaccacgatgcgctgaaatgacagcatgggtatttttaccaccagttggataacttgtaccatccaataaacaggcgccaaattgtagaagccaatcgcttgtatgatcaaaaaccggcagactaaggccaattttgggaatcgtcaactgagcaactgtctgccgagtcaagatttgttgattgcgtttggctgctgtttttgcggttccttgatcattaacagcatgattaaaactggcaacgccgggcacttgttgacttgctgccaactgtttatttttttgctgatagtcgttatattcccgccgcaacaccatctgattcttccgcgcttcttgttgtcgatacctgtcgatgacttgctgattttggtaagaaacgtaagcatcacttgcaaatggatagcataaaacaccaaaacccgctaaaagaagacatccaatcacaatatcaatcaagtctaaaggtcgacgtgttcgttttgtcactctgattacctcgccatatcaaaacaagagcgccatcgacgctcttgcttgactcatttatcttattaactttttagaaaccattgcggcgcttgcgataggcaactgctccaaatgcaattaaggcaacgcccaaaatcgcaaaaatgactgtgccagtaccaccagtgtgtggcagaataccgcttggtgcatctagaatgtcgctagacgaattatcagctttaaagtctgtattggcagcagcatcataaccatccggcacgtttgtttcaactgccgtgtaagttgtggtgttatcagcaaatccatttaagccaaacttaccgctcttatcagacgtgaaaacagtagcatcgctttcagcaacccacgtcaatcgatagttattggccaatacatcgataaatccttcgccgatgctgacgctttgaccatctttatctgtcaacttcaaaaacttgccatcactattgctaatcttaaagccggctccttcaagcacttctttagtctcagcatctttcttaacaaaagtgcgctcataggtggtcttttgaacattctttgggtagacatagacattcccgtcggctgctgccttggctggtaaggttaaccagaaatcggcagacgtgttataaccagctcgcggattggtttcatggaaaagatagacagcagcacgagtcttaccactggcatcttttgattggataggtaatgcttgggttagttgccccttgtcattagtcgtaccggttgcggcaaccggagcactatcaaaactgcctttataatccttaggcgatgcccaataattggctgtcacgttgtaaatggtgaaatcaacgccttgtaaaggcttagcaccatcgccggtccaaatttgatcagtcgcacgatcaatggcagtaacatctttgtcaaacccgtatttagtaaggacaacgttttgtgttgtcgtatcattcgtatctgcttgaacccgagtgccattaaacccgagaaccatcagtaatgtcattaggatcgtgctggttaatgtcagcactttcttggcaattgtctttttcattcttatctctcccacttattaattttttggttttttatgttaaaagcaagtactgtcgcgaagattatcaacccgagcactgaaagccaagctgcaactgtatcacccgtttgtggcaacaattgacgtattttctttggaacttttttgggggcatcggtgtgacgacttaccattttgttcttaggaaataaatcaatgcgtgattgattcccatgttgaaggttgcttgacatgacaaccacaagattctgactggcttcaatattcttaggtgccgccgtttctttaaaaagataaaccgcagcatgctgcccctgtcggagtggtaaatcgccaaagtacgcttctccctgaccagccgtcacaacctgtgcgataaggctggagctagcaggctgatagctatcttgactcaacgtcgtttgtgctacctcaatcgcaccgccatttttggagacaagctgccaaaagtcagcggtcacgtcataaactgtgaacgtcacaccgtttaacggcacatctgcctgcgaaaagtcgggttttgttgtcccgttatttgcttgttgagttggcaaggtatctttaaacaacagcttatgcaacacaacatcaacagtggtcggcacagttgccgcctgtgtctgctgcaacgttgtcgttgccaaactgactagtagtgccaagcaaaaggtcaaaatcactaacggacggaaggatttagtcatgttgcttcaccacccgtcgctttatcaaaacaaccagtaataaaaggaacgctgcgctgatcaatcccagtgcgataccaagcaatcgctgatagccctgaccacctgtatgcggcaaaattgcaagtggctgattaatcgcctgcaaagtgatcgtgctgccatcaatcgctaatgtgtatccgttcttactttcgcccggcttcaatgcctcaccgtcaatcgtgacggttgcctctttaccagtcgtagctacctgaatggcaatctttgcaggattgctttgatagccatctggtgcttttgtttctgacatcgtataggtaccatctgcaactaattttgtcgcaaacgcttgtccctcagatgtcgccgatgatgttatcgtctcagcttcgccagcacttggttgcagggtgaacgctgcacctgcaagatattggctttgattatcctgtttgatgacccgcaaagtcatggatggctttggttcatcatatttcgttagcgtcagaatttgctggtgatccccggtcaccgtaaaatcatctgacttatcaccaacaggattcaaagtctgctggccattaataacactccctgatgtcacattgtcctttgtgccatggtattgccattgcccatcagacgttagctgaaaaagatacgttgtcccatcaagttgataacctgtaggtgctgcagcttcctgaataccgtaataccctggcgctagtgcctgcagatccgttgacgtgatggcgttggttttggatgcctgctgaaaactgttatcgctgtactgggttaagttaaactgcatggccttcaactgatctgctgataaatcagtaccatcggttgtttttttctgaaactgaaaaccatactgctgatttgtcaaagtcaacgttgctgtttgctgatccatattttgagaactgataaacgaactcaaatcaattcccgaggcatcttcactcttaacgacatatgaaaaactttgaccctgattgttatacgcaggtgccgtaaagctagctttccagttatcagcttttttaaggactaaggtctgttgccaatttggatcaagcgaaccgtcagccacttttcgctgcaccgtgacgttgagcgtatccggtaacgattgattgcttaactggcgccattgcttctgcacataaactgtagttgctggtgccctgcctgaaggaatcccaaagtcaacagcggcagcgcccgcttttggtgtcaacaatgtttcaccattcatttggtaccaaaaatcaggcttgaagccagcatcctctgttttgatccgtacttgataatggatttgaacttcctgatcctgacccaagttcatgtgattcaccgtcaattgaccatcttggatcgccgcacttggcaactcacttgctggcacagtttgcttgccgacactcgtaacggtcgcctggttgttcgcatattgaaattgcgtaccaatcgggtctgtgatcgtgccgtcggtgacagtattaaagtttttgataatgtcctttgcctgattgttcaaataagcctcaacagcatcggcactatcagcatcttcgtataaatccggtgaattggtaataagctgcatgttttggcgtattttttctttcgtcatgtagtggtcgtcgtcagccagttggatgcctaacgcgtgcacctcattaccactatcctttgctatcttggcctcacccaatgttgctggccaagtatcatatatataatgacctgaactatcggtgtatggccatcgaagtcgtgcggtgttccctggttcatctctgctggatccaaaattagtgccatacaatgtaccatttatccactctgaatttatcacctcgttagaaaaagtcggcacgccatcagttaacaaaatcatcatttttttattgccactggtgtccgcattcagcatggctgatccttgccgcaaaccaatctgcgtatacgtacccccttgaaaccttggactcaatgcaccattaatcgcttgttgctggctggcattacctgctttgcctaatttgacactaatataacccgatttgccaccgatataaccaggactagaaaacccaattaaaccaacattgacgtaattacccagaccggcgttttgaatagaagtcaagaaattcttaacgccagtacgaacagcaccagctcgattcgtgccccatctgtttgactccattgacccagacatatcaacaactaagacaatatctacaggcttcacattttgctgtttattgcctttgacgttcaaataaacgtcgtacaatccaggggtattcgtctctttagcatattttcgaatctgataatccggattattggggtcaccaaatttcaggtaagagttcgtggtatcagtcgcatcaccattccatattgtattattatcccaccctgaaacttgatccccgccacgttgattgattacattttgttgtcccgtgacctgccacgaatttgtcggataggtaccattagcatcggtttgataggttgggcgaatgttatcagtggctgtcacaactgaactgccacttgtcactaagcctgttaacatactcatcaaaatcaataagaccgcgaacaaatgcccagttctcgccactttagctgtcatcttcgtaaattttaccctcctctcaagtaaaattttaaccccagtttacaattcaagtgcaacaccctgacgactagaccataaaggccatgaagacctattcttgttagtgctagctaaacaagaaagcaggaatcttcatgacccactctcagactaacacccacaagcattaccaacaactcagttttagcgaccgtgctacaattcaggcccttcaggctgctggtgacaccgcgaccgtgattgcacagaagcttcatcgcagtaaagcgacaatctcacgagaaatcacgcgtggatctgtaactcagctcgactcgaagcgtcactcgcatcaagtctatcttgcggaaactgcccaagccatgcacgaccgtaaacgcgatagaaccggtcactacgcctttcttaagaccggccgtgcgttcttcaaggctctcgccagggagcttactcgtaagccgcgcgtacacagcgttgatagcttcgtacacttctatcgcgaccagggcaaggcttgcccttcaacgacaactgtgtatcgctacatcgacgccgggctgcttgcgctagacaacatgacacttcccaagaagctccgacgccgcatcaaaggctataagaacgcccacaagcgcaagaataagaagatatacggcgactcaatcgagttgcgtcctgcggccgtgaatgaccgcacaggcgtgggacattgggaaggcgacttggtcaaaggtattcgcttagctgatgagccagcattaatgacgctcacagaacggtacagccggactgagatcatcgtcaagattcctgactatcatgcggacacctgccttaaagccttgcaggacacgatcgacgactacggggccaaggaatttgagagtatcacttttgacaatggttccgagtttgccaagttatcagagattgttggaacccagatttacttcgcacatccgtactcgccttgggagcgtggcacaaacgagaacgccaatggactgcttagggaattcttcccgaaagggaagtccctcagagcagttaccctggttgaaattcaagcagtccaatccgcactgaaccatcgtcccagacgtattctgaactatcttcgcccatgcgattactaccgatgcatggcgtaacagcctagaccactatcaagaattcgttatcatcgttgcacttgacttgaaaattgaggaagtaaaattttaaacactgacagtgcaatcattcatgcgcttacaactcgaaagttttgagctatagactgcacaaataaaatatacatcaattaaattataattgatagtcaatataacaaattttcttccatttttagtttttgcctttgttatctacatcactttaaaaaaaagtaaaagagctcaaaactttcgagttacgatcacttgttaatccactttttacccaataattcttaaaaattcagattttacgctacaattaattaattcaatcaacactgtctgatttttagttcctaactagtggctgctttcaccagtcacttcttaggcatctgtgcgcctccttccattgtttccggcgtctctcttcttccaacaccagcttaacaagttgaccccgcgcaaaggaacgataatgttcgttatttaacaagatatttttaacagtgcatacttatttacattataggtattaatctgtacatataatgtaaaaagctatatttataggtaaataaggtcttcaaacccaaaagtagccttgaaacatccggcgtattgccagtaagtcccaagactacttataggttatttattcaactaattagtttaagctttgatgattttcccaactgcaattggtaaagtaacgtgggcatcgtagttcatgacagttccttgaacagtagccggtagcttcaaggtatccggcacaccatgaatataaatgacccttttatcgagctgcaaatcgtcactgccaaaagcggctttaaacgctgtctgcaattccttcagatcaacgagtttgtcataagcatagtgaccttctgcatcagccactgggtaactgtcatttggcacatgcatcttggccggttcagcgtcaaatggcaccatcgttgtaccggaaaccggttctgtttctggcagatcaacgaaaccgtcaccattagcatcttgtgccgctgtggcgatttctgctggcttaccatccgggaatccgtggaaatgttcccaatgctgcacattagaaggtgtatcaaacatatcgatatgaatcttcatttgcgcaccatcaatcgtgaatgtcgcggcaccgtgcggcgcggtgccaatcttctcagcgttcaatggcacaatttctgctttatacttttcagccatgcaaagcacttcttttagatttagactcagtttctgtatagtgctaactggaacgactcacaatctattgcatttcaaaagtgaggttgcaagattatttggccaattgcaataaccgttggcgcaaagcaggatcagctgcgtaaagataaagcccgtgcttcgccctcttcagcagaatattaatggcattcatgataatcgcggctttagcgtcggtggtgtcggccaaatccgggcgctttttgaatgcttccttgtcttggtactgcgccagatcaaccgtaagtcggtcttttgagggatcatagcctagactcggccctagaatcacacctgcgtaattcaagtcaaagccttgaatagtataaatggaaccaacttcatgcaatgtctcaggacgttgtgcccacgggcgatcggtgaagttgatcttgtcccaaggcaaccgcagagagccagcttggacataccaggttttaccatcgagcactgtgaatggatagtcagctgtagcgatcatgcgcgaaaggccggtttcggcattgcgccgctgaatgaggtcatacatcggctgaccatcagaaaaaacttgaaaatcaaaatgttgcggatgtggcaaaggcaacatttttccacgaacaaaatgatcaatccaatcattcaccgccgtatcgcctccccgcatctattcggtcagatgataatgtgtcactgcgtaatcgcgcgtcactcttttcaataaagcaggtgtccaaaaactctttagcttgactagctggtggaaatcgaacacgagcaccaccactcgagccaactgaagaatatcagcaagctgattatgcccacggaatttattatacggatcaggcgtcgtcagtagtaaatggccttcatcgatcagcacgacatctgcccgcttaccggctttgcggtacgcgttaataaatggtgttagtttcatggtagattgtaaaattaatccgaacagcgttcggattaattttacaatctaccatttactatgattattagtaactattttgcctctacccaaccgtgtgtcaataagctcgtttttttttcatcagcaagatcttgactgggaattgcaactgctaataagtactttggacgacttaatgctacatatgctagtttaagacaatcccgctgtaactgttctatttctggatccgatgaaaaatctggtcggtctcctagtaaataaggaaagatagttttgaagaacttattgattttgtcttcttcattaaacttcatgtgtacacatgaagttagtaaaagcagtgtcgatcgatgtgtttcacctttaactccgtgaattgttgcaaattctcggtggactgtcgataaattcattctttcaggttcaccttctaggttgctaacgtcttgaagcagatgcttgcattctctttgcaaataagcttctgaaatagtttctgaaccaattagactgtacaaatgatattgtacctcgttcaatgaaatattttgttttgcgagtttctggatgacatctgctaattcaaggttgctatcatgattattacggattagtactgattcttccataaaagaaacgccattcgcattggccaataatttgataaccaatgcataaatttcactgacacttctttcatgagctcgttgctctgaaccttctttggaatatttgggttcaacttttataatgtcactgtgcattattccgacaatagcatctggtttctgcaatatacgaaaatttggatttgaactggcagcgtcttcgatcagccgagtatgcttttccttgagttcgtctccagtttcatatgtcataaaatacttcggaaagaaatttagttcttgattcgaatggaattgttcatattcctgaacacaaacatgtttaactacagcagcaattaaactgccaaaccttgtagtttcagagatttctttagtctggtagaattcgttatcgggtctcgggttccaagagtcctctgtctcggatccatagatagtatataatgcttgatacggatctccaaatctttgtacattcaactgtttgccattagccagaccatttataatggcaaactgaatccaatcggtatcttgagcttcatcgatcattaagtatgaaaatcgtttctcaaatgccacgctcaactcgtctctatgtttacttagataccaataagacaatgatttgagatcagaatatgaaacatagccatcccttaacagccattcgcatgcacgattaatggcatattgacaacgctgattctggtgtctgttagtgtaataaaatgatccgtcatctaaaattactagcttgcacccatttttggacggcttaggtacgttccaatctgaacgatagtccttaacaattctcctaaaatttttatcatacttttcatagaacttttcatcatctaaaagcttaagcgtcacaccgggtaggaccgtggcaaatgcagttttacctaaaaatttatccatgaaactttgaatagttcctacaaaatttggatattcaatttcatccacaccagcaagcttcaaccgtgctaaaatctcttttacagcaacattggtatgtgtaatacagcagatgcctttatcttcgtagttgcgagtggtcaataaccttaacaccttcgctgctaatacggttgttttacctgatccaggtccagctacgacgtcaattcgtcctattgcttgaataacttctcgctgttccgctgtaaaatgcgcaccgtgcaacaatatgctttcaatttgcatcaagttcaatcttgttcaacctcctgcccacttgcaaacttaatcgcattaattaaatacttgcattcttcattttgtgaatgtgttgtatcgccaataattttatttttcagctcttccttttcatcttgactaagacccataattagttttgctaattgttcactaacctgtgtttttgaaaccgagcctttgttcaaggctgcatacgcattgtatgcagccttattcggacttgttttataatcttcttcaaattttttaataagtttttcccgatgattttctctaacgaattgtgtttcagctatcgcttgaatcgtaagatgacgcaaagagctacgcaaaagactgtactccaaagtccataatggcgacatgaatactttactattggaactaaattcttcgtatttttgattgagacactcttgcctttctgctgtcttactggcccagtcagaatcagatcggaatttttttacttgaataattaaattcttaattttagtattttcaaatcttagtttaaaagcagctactaattcagcaaaagtcgcatactcctctccgaacaagtcaacattcaaatcgctagggccactaatcaactcctggattttttcagcgctctctgaatcgataccatacacagtcggattaatatctgaatctgtaattatagagatagggataccaattttttctgatttttctttttgagaaaacagtttaatatattgattaaagcttgtcccgccaacgtttacaattgagataccagaacgatgtaacggtaaatttattaaatctgccagggctggtaataaaatattttccgcatatccctccaccaaaataattccttttgcaaagaataggttactctttgttgcatctaaaaatcgattcaaaaaatcataatcagcttcctcaagcatggtgtcctcaggtgccatcgaataggctttattagcgttcatatatatcagcgatctttgatctatcgatgcggtcagtgcaacactatgtgaagtcaatataaactgctgagatgaattatcctctgtgctaagaatatagcgctcgatgtatttaattagtcgtatctgagcctgcacgtgcaagtgcgcctctaattcctctataagcataatgtttggaccataaaccactgaacttgaatgatcctttagcagcgctaactcggtcgaaatgtacaacaggttcaagttccccaatcccaaattgacgctttctgaacttaaacttagctgtttgaatatttgatcaagtgtaacttgtgttagttgaaagcgcgtgtcacttttatcctgatcttgactatcaaataactgcctcaataccgaatgaagttctttattaattgattgtttttccaaattattatcagaaagatgatcgttatctttaggtggattcgattcacttggaaagccatctgagagatatccctctattattgcgttggcttcctccaacgcttggacaagttttaatttatgttctgggtgatttcgaaactccgagtgtgctgcaagtaattgtggcagatgtgagcgaaagccaggagttaattcatctgttgcatttctcagagcttttaagtatgtaacacgtaagtatactcgtgccccacttgctaacgaagattctgcaccttcatctcctgcaactagatttcgatctaaatattgacgtccagcttcactcgttttgcgctcaactgttagttttacatgtaactcatattcattattatcgtcaaacgacagccactctagaaaagttccagcctcgtacttgttgagactacaaaatacagcctcaatcttaaaatcatttgaaaactcggtcccgtcaaaatagaaatcctcgtcttgaatactggttcgatcatcgctaactgttccaagcaacactttaattgcatcgataactgcagttttccctgaatcattttcaccgacaatgatattcaagcccggatgaaattttactatcaatccaggttccccattcacctgagaaacaaattttcgaaaatcatacagtttaacagtttttagaaacactatacattcctccctagggacattctactatcccactcattatgcaaaaatacgactaaatgctcgaaaaattcgcttataaccagatgacctacacactaagtagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaagtatacaactagcgtatgttgacacatgtataaagtgattccaaattcaaacaaatcaacaaattggtacgttgaacaattaatcaataattgggtattgggttctctacatgattagaccattaaagagcaattccatattatggatgtaagctgattcctgagacaacttttaagagagggtataatgaataaatcgtctctcaaaaggaaggaatttttacatgccaactcgttacgacaaagaattcaaaaaaaacattatcaacctatataagcaaggcgaatcagctgcccaactggccagagaatatggcattggctattcaacagttcataagtggatccagggccaggacaaaactcaatccggtaaatcgccagacgaaatcaaagcgatggaaaagcgactggcttcgctgtctgaggagaacgaaatcctaaaaaaagccctggacttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcggacttgaaacaacggattatgcggatctttgcggaatttaagcagcgatacggtgttatgaagatccaccatgaattgaatctggaacttcaaccactgcagcttcggtgcagtccacgacggatttcccggctcatgaaggaactggatatccactccgttaccgtcaataagtggaaagcggcttcggcttccaaaaccaaggttgaacagcgtcccaacttgcttaagcaggatttctcgaccactggtttaaatcaaaaatggaccgctgatatgacctatattcaaacgaagcgtaatggctggtgctacttatcaaccatcatggacctgcactcacgacggattatcggctattcgttctcaaaaaagatggctactgatttagtcttaaagacccttgaaagcgcggttaaaaatcgaaccattactggggacctgattatccatacggatttaggatcacagtataccagcgataattacaatcaacgtttaactgaactacatatccgccactcatacagccgtaagggttgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaattcatagttcactgggctactagacccccttacaagttgaaattgcaacacttacgagccaaatggccgcctgatttaatgctttccagggttcaaataagttattaatcgcgattaatgatttatttgagctgtggaaggtaaacgcggttctgaatgtctcttaaaatctgtctcaaatattgacttcaatccagtccggctgcaatagttttaggaaacaaagagtttccatttttgttcgtttcaaatagtttattaagagggaaaagattagctgtttaaaaaagtgggtttgcaaaaaagaccattttaattgaagtgcaatagaaaagttagacaatttagattttgaattaagcaatcatggcttgttcccggtactcaactggggtcaagccatttttgtttctcgaaattctgacattgttaaaccaatccacgtaaccgttcaccagcttgcgcagatctgagagcgtgttgatctgataccgattcaagcactcacgttttaggaggttgaagaagctttcgatgggcgcattatcgtgacagttacctttacgagacatgctctgtataatgttcatagccttgagacattgctggtagtccaccatttgatattgccacccttgatcagagtgaagagttggtttgatgccttctttaaggtgatgctctaattcatcaagtgacgcttgaatcaaagccttattgggagaagcactgacaatagccgcgatcacttcacggctggcttcatctgtgattgacgagatatagccccactcgccgttgtacagccgtacctgggtcacatcggtatggaacactgtgagtggctgtgtggtttcaaacttctgattcaagatgttaggtgcaatgagaccaacgtgacctttgtaggagtgatatttggaagtatgtttagagtaaatcacacatttcaatcccatatcactcattaggcgtctaattgtttcctcggcatagtggaagccgactttgtctgcttcatcgtgaattcgacgatacccataagtctctttcgaaccgaaaaaacacttcttgatgaaggctttgacctcggcatacttatcaggcttcttatcacgcctaagccgatcgtaataagtcgctcgaggtaagtggagggacttaagcagctcattgagatcgtattgcgaccttaacgaagtcacgatgccagcctttactttcgtagagagtgcttcggtgaattcttcgtcagagtcgcgagtgcttttaaaatatcacggtccaattcagcttcgtgcagcttgcttttaagctccagaatttcttacttatacttctcctcttgcgttggctcgagcttcttgattggtttgatttgcttgtgcttacccataggcggtcttcctttacgctgcgcacgtaaaccggtaactccttggtcctttacgatacgaatccaactgagagttgacttggctgggagagataccgaaatgcgcggcagctcgaactctgcttacttgatgtgtatgcacatactctaccacagtaattttaaaggtctgcgaatacgtagtcttgttgtgtttgaccttcaaagactcgataccgtgcgtcctagcttgattgacccaggttcgaatattagcgcgcgaaggaataccatatcgaacgctgagctctctgtaaccaataccgcctttcaagtattcagaaaccacttttgcctttaattcgttactatatttggtcacaagaaatgccccacaatcgttagacttcttgtctaataattgtagggcacttcaaatcggctgatcgaggactttttggtattcgtccagcacgtcattcggcaagggcgtcagtaaatgcaggtcatcgatgacatcgctggccgtgtcggtgctgggcaaatcaacgaaaaggtcgattttactgagacaatcacttagtagatcggtcagctgcgaaagcggcttgccgttttcatcggtgatcacgacctggcgatgattgaggggctggtgctcgatctgaatcattttcagcgcatgataaacattcaactggctcacctcgatatggttaccccgattgtaggcaatctggcccgaaaaaacaatctttaatcatgctctggcgcggcctggcgctctggggctaccggcgggcgatgccaacgcagccacagttctttgattccagacaaaatgagggtcggtagcgccgggatgaagactaccgcagcatacagcgtgctagaaagtggcgcggtccccatcacttcgttgaagaacggcatgatggtgacaagtaatgaagccaccgccgcgaaagccactgccagcagcaactgatggttttcaaacgggttgcgggcgaacaaagtgcgggtgctacgcgcgtcgaacacatgccacagctggccaaacaccagggtcaaaaaggcgagggtttgcgcttctgcgccgctcatgccttgactggcagcccagatgaaggcgacatacacgagcccacccatcacaatgccgcgcaggaagatgcgcccgagcatgccatgcaaaatggattgtttcacattgcgcggcggctggttcatgaggtcggcttctggcacatcatagccgagggcaaagctcggtaaagcatcggaaatcatgttcacccacagcaccatcagcgccgttaatgttggggtggtggccgccacttggccgacgggttgcgtcatcagtagcacgccgaacagcagcgccaacacctcggcgacattggtggttaactcatgccgcataaagtttttgatattgccaaaaatggtgcggccggcgcggacactgcgctcgatggtggtgaatttatcatccagtaaaatcagatctgcggcgtctttggtgacttcggtgccattaatgcccatggcaatgccaatgtcagcagcgcgtaaggctggcgcgtcattgatgccatcaccagtcatggccacggtttcgccatgccgctgcaaggcgcgcacgatgcgctgcttgtgttccggcgacacccgggcatatacgcggatgcttggcgcgagccggaacaaatcttcatcggtcatggcttccagctgcttgccttccactacccgggcgctagggtcggtgacaatgcccagctttaaggcaatcgcgcgggcggtgactgcgtgatcgccggtgatcatcacgacctgaataccggcttggtgcaaggtggtcacactttggcgcacttccggccgcggcgggtcaatgatgccggcaatgcctagtaaggtcaggtgctgctcaagctcagcggtgctaccatgcaacgccaggtcctcgtcgatgtcacgcagcgtcaccgccagcgtccgcagcgcctgttcggcaaagcggttgacctgcgcttctaccgcagtttgaccagctggcaatgttacgagttggtcgtggtccagaatggcatcagttttggctaaaatcacgtctggcgcacctttagtcagcacctgatactggtcgccatctttaatgacgacactcatcattttacggtcgctgtcaaacggcagttcgcgaatgatgtcgatgtccagcgcctggtctttgctcaaaatcgtatcgcgatcgataccaaatttgtggcccatcactaccagcgctacgtcggtggggttgccatacgggcggctgcggccttcgtcgtcggtttgaatcgccgcttcgttattcaggacagcggccatcatgaagcgcgaaaatccgggggtgtcggcttcgtcatcagggatgatttcgcctactggttcatagccgtcgccttccaccacataactggcgccattggcataaaaccgggtgacagtcatttcatttttggtcaaggtaccagttttatctgaggcaatgtagctggtggcccctagggtttccacactgttcagggacttgatcagaccgttgtttttggccagcatcgtggccccaatcgtgagcacaattgacagcaccgccggtagcgcatcgggaatcgcggccaccgccaaggcaatcgccgtagagagggattcggccagcgcagcgaaggagagactgccagtttgctgataggctttcaagagctccaccagcaacgtgaacgccacaatcaccatcgccaccatcatcagtttggtggtcaggcgcgcaatggtgcgttcaatcggggtctttttgtccttgacttgatccagcaaggtggcgattttgcccagctcggtttgcatgccggtcgcaaccaccaccccgaggccgttaccatgcgtcactgtcgcaccagaaaagcccatgttggtgcggtcaccgatttgcacgtcagcgcccaatgcgtgggtttgtttttgcacaggttccgcttcgccggtgaggtgggcttcgttggtttgcagctcggcgacatggagccagcgaacgtcggcttcgatgaagtcgccggttttgacactgacaatatcgccaggcaccagctcggtggctggcaccgtcagccagtcgccatcgcgcaggaccttggcgtggtgatccgccatcaccttcagggcgtccagggatttttgtgcgcttttggcttgccagaaggagaggccggcattaacgaaaatcagcagcagaatcgcaatgctttcatacactgccgccataccatggctggggtcgtggcgcacgaagaagtcatagccggcgctggcccaggccaatagcacggcgatgaataaaataatcaccaagggttctttcaaggtggccaaaaactggcgccaggctggtaggggcttgctggcggccaaggcgttggggccatgctgggtgagccgggcctgtgcttcttcactggtgaggccgctttgccggctggtggccaagcgctttaggacatctgctttgtgttcgttgtaaggggtcataagtttcctccaataagaaaaggccgcacccaagaatcgctttcctccccgagaaagctttcttgagcaccgcccaaccgaattttttgaattagttaccttttattactagtttaaaggatacctaatgttgctgtcaaaagatttggcccgggccgccggtggcgtgggcggtgggctccgcttggggcgcgcggcctgctgtgcggccggtccgagccacagtacggtctcgggcctaattttagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcacactgtctaccgctattacgatatgtggcgagataaaccagacccgacagctgattcgctattagaaaggcttttaaaaaaactgttgcttcctatcgctttgcatagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaatggtttaccacaagccattctcgtgacacgagctaatgtatcagatcgttcaggtgcattggctatgtttagtttggctagccaaaatttagagctggttcagcatgtcatggttgatggtggctacactggcaatgactttgcggatcaggtgaagctcattttgaatgctaagacgacggtagctaaacgcaacgagttgcatatgttcacggtgttaccgcaacgatggatcgttgaacgttcatggagttggctagacaaatgtcggcgactttggaaaaactgtgaacgtgcccttaacggcagtcttcaaatggttgtattggccttcctgaagatagttctcaaaagatactagacaggttcttagtagtttacatgacgagccgcatgtttgagtagtaatggtgctaataacgttgttaggataatggcagtgataattgccgaatagtaatcatcactgattagtttggattggtagcctatttgagcgataatcaaggccatttccccacgcgagaccatccccgcaccaacgaggtaagcttcattcgaactgaatccggcccatttagccccacttcccgctcctaatagttttgtcagtgttgccacaatcgtcaatacgataattaataacaaatcgtgttctatgccagctagtgacatatttaaaccaattgaaacgaagaatacaggaatgaaaatcgcataaccgattggttcgatactttgatcaacttcatgagctacatgagtttgtgcaatcgcaattcctgcaaaaaaggccccaattactgcactcagtccaatcagatctgcaatatatgccataccaaaacacaaaatcatcgccattatagtaggtcccactggattcaataatttggtgcctagtctagcgaggagaggggcgataaaacgcatcacgaaataaattgcggcaaagtaaattagctgctctaaaaaagtcagagctagcggtatctgggtatccgtaccagcctttgtacctattaaactgaccataatgctaagtaaaacgacagctagcacatcgtcaaccaccgcggcaccgaggactgttgaaccgctcttactatcaagtaaatttagttctttcatgacagcaactgaaattgaaaccgacgttgcggcaaaaataacgctcaaaaacaagctttcaaattgtgtcaagccaaaaacaataccaactggatagatcagtaccatcggaatcaaaactcctaacaacgcgacaattatgctaggacgcaaatattttttaagcaatgtaagatcactctcaagtccggcgataaacattaagatgataaccccaatctctgaaaaaatatggatgaaatcattggcgtgaacccaattcaacaacgcaggaccaagaataattccaacaaataattgaccgatcactgctgggataccaaccctagaggctagatggccaaatagactagttgcaatcaagatgatcaccaaggtacctaaaaattccaaacaaaaacctcctcatacaaaaaacgtaaacccagatacctcttacacacccctgaaagagaacaccttgagcttacgtcaaccgatttatttattcatattttaataatacttcttatatgctagcaaactaatcaaaaatattcaagtaacgataagttgtcacatttagttacttattcgaaacacagacaccgccaactttaaaagtgatttctgaattttctttacctattttaaatatctggatcgttttctccagctataaatcatgctggatacataaccgagctaaaaagacaccgtaggtatattatcaggtccaaggaatccaaactagcagcgaccaaaacatcattgatttcttgtttgaggctggtgtaattcttcttttctatgatgaaccttaaaaggatctggtgcaaacagtctgagagatgaccatctaaccagctattgatcctatgttgaaggttatgcagctaacaatgcttctaagaacctgtctagtatcttttaagaactatcttcaggaaggccaatacaaccatttgaagactgccgttaagggcacgttcacagtttttccaaagtcgccgacatttgtctagccaactccatgaacgttcaacgatccatcgttgcggtaacaccgtgaacatatgcaactcgttgcgtttagctaccgtcgtcttagcattcaaaatgagcttcacctgatccgcaaagtcattgccagtgtagccaccatcaaccatgacatgctgaaccagctctaaattttggctagccaaactaaacatagccaatgcacctgaacgatccgatacattagctcgtgtcacgagaatggcttgtggtaaaccattaatatcaaccgccatatgacgcttaatccctgaaatctttttgccgccatcgtagccactatttttcgttaaatcagtggttttaacactttgagcatcaacaatcacaaacgacgttcgggccgatcggccctgtgcaaaacgataggaagcgacagtttttttaaaagcctttctaatagcgaatcagctgtcgggtctggtttatctcgccacatatcgtaatagcggtagacggtatgccattccgggaaatcgtgcggtaattcacgccattgacaccctgtagtaagcgagtaaaggatggcattgaatacgtcataaagatcataacgacgcggtcttgtatgcttacggaagttttctaaatcaggttgtattaacgcaaattgcgctcgagaaatattgcttggataatctggcatgacaaactcctcagtcggttttccacaattctaccagattcagcagatactagacaggttctaactcgtccacgactgagaacccgatgagacttaactctcgtagggttcttttgcgtattgcgtgaacaatttccacaccgctcaacgttgcactagcggttcgaatgctttgaaagcttgctgagcggacacgatgacgtttaatgaatcggtggtcctgttcaatcaaattatttcgatatttggaacattggtgggctgatttgctcaaatagtcttgctttatcaggtgcttcactgctttcagtgttgcccgatattgatcagtgactaatcgatcaggccgaccattggtcgtcaagagacgcttcaaaaagtgataggatgcggtataatcgcggtgttttcgtagctcaaaatccatggtcaaaccgttactgtcaatagcgcgatacaaataggcccaacggcctttaactcgaatataggtctcatcgattcgccaacttttagcgtgagctgtttgatgccgacgccatagagccttaaagatggggccatagtgatgaacccaacgcatgaccgtggtgtgatgaacagtgataccccgatcccgaagcaattcaacgatgtcacgatagctgagactgaatctgaaatagtagccaacggctactaagatgatgtccttttgaaagtggcgtcccttaaagtgattcatgcgcgcaatccctcgtttcttggcacccagtatactaaaatcaagtcagcgaggaaaatttgcaccagaaccgtggctttaatcacacgggaaaacaggtgtaaacagtttgccatttcggtatatcgtgaggtagctgataccatttagagtcaatacgaaactctaaaaggccatcaaagatgccgagtaaattaacttttcaaggacataatttcttacgaaatggttctagatcaatgtgaattaattcaaactgagaacggatgatgagacaaaaatcattcattttttaatagacttgatctaaaagctaagttattttccaagatatcaaacaacttcttaacccaagaatcttccacacataggacaataatgaatccaaatagattcagctttttcctgcaaaccgggatcagtataaacgtccagtaccggataatcacgcattaagttcagctgccaatgggtatcatctaaattaaaaagatccgatttagtgtctccccttactacattatggcaatacacacaactgttgttatacatgcttccttgctttttgattttaaactcctccattttgcatattataagaagattacttctacttgatatatagatgctttccttgcgagggtaagtcagacaaggaagcatttctaacttgagatacttaagcttgtctcaatagatgtagatagcggctccccaatcggatattaacagctcaactagtcaaaccagatatataaatgtgacacaagctggaatatatatcattatctagataattcaaattaagctaataaaatcaataaagaaaattttaaataacattattttataaacccctttaggattttcccgatttgatattctacgtatgttcgtttagttgcgtcagttaaaattactaaactgtcaccttcatgaatcaaggaatcaccgtgtggaatcacttcctgttcgccacgccggattccgattagtaatgcttctttaggccatggcatatcgcggaccattttgccattcaagggactgccgaagaaaaccggtatttccagtcggtcgggtcgatgaagctgttgaactgttttcggcattgtcatttgctcgagtaacgcttcatagatcggcgcaccgccaagcaaatcaaccacgagataagcagttaacgataggaccgctaacggcatcaaatgcgtcaaattaccaaccatctccgttaccaatagaatcgcagtaaacggtgctttcccaatgccagcaaagtaaccggccattgaaaaaatgattaagttcatgatataaacgtgcggcaataagccgagttgattcatgaagacgccataaatggcaccaatcacggcacccaaagaaagaatcggcagaaaaatgacacctggtaatccagaaccatatgaaatcattgaaaaaacgaaacgtacaacaaaaattgcgatcaatacaagcaaagatggcacatactggccaaaaccgacaatcaaaccattgccaccaccaagtaagtttggtgcaaaatagccaaccagaatcaccagcagaaacggtacaatgccttgtaatggccgcggtaaatgtgtcaagttgcgataccaccgcggcatcaccaacaagattcgctggtataagtacccaaacaagcccaaaagaatgcctagcaaaattaaatgccaataactcgatacaggtaaactacgcgaatagcttaaatgcagcaccggaacaagtccgaaaacattcagtgaaacaaaatccgatccaattgccccagccaatgccgttaaccaaacaagcggtgagaaattatggtaaacctcttctaagacaaacaaggtcccagcaatgggtgcattaaatgctgccgccaagccagcagcagaaccggatgcaattaacaatctccgatcagttcctgatagcttgaatctagcagctaaaccttgcccgactgaagcgcctaactgaatcgacggtccttcccgtccgagaaacaacccaggccccagcgccagaacaccgccgacaaattttcgccagaggatcgaccaccagtgcatctccaattcaccagccaactggccttcaacttgcggaatcccagagccagaaatatagggctctttcttgagaagccacgccacgatcaacgccaaaccaagattgacaccgatcaacaacgcccattgccaccagacaaacggtgctattcgcaagtgcccatataccagccgactatagcgcagccctacctcaatacaatagcgaaacgcgctgacaacagtgccgctcattaaaccaacaagtagtccgagtagcacagatcgtaggcgagtaaggttaaatttttcttttacaaactgtgtcagatatctcatctcccagtataccttctacttaatatagaactgagattgtaaaatctaagttactaaacataagatgttccaaactccggtcttttttagaaactgtctagtatcccttaagatggttttaaataagcaaattagttggataccattattacactcctatatttaggatcaaaaattcctaaaacattaagaaaacatatttgtttccaacgaaagaagtagtaagccctacctagattgcataattaaagttaccacccagaaaatgtgaaaaaagacctgtccgttcttgctaaaatggtgtttgcataacataccatctagagagaaggacaggtcccatggccattataaccttaattgaacgatctcagatagaactgatgcaacaccacacgattcaatacatcgccgcgaccttaggccgctctcgtatttctattaggcatgagcttcaccgttgccctgaaggtgattactgcgccattatagctcaggatcatgccgatacttgtcggcatcgttgtggtcggcactcgattttaacgcctaagttgaagcggatggtaactgagaagctaaacctaggttggtcccctgaaatggtcggttatgccgttcactgtgcgccacacacgatttaccactggatttatcaaagacaagtcgattttcagccaagccaactctttgatcacggtaaacgtcataaaagaagacaagaccttcggtcgcgctataaccaagcagtaggcacctcaattgagattcgcagtgagtcagctaatcggcgaaccgaaaaaggacatttagagatggatacagttcgcggtggtcgcgggtcaaaggctgctgttttgaccattgtcgatcgggtgacacgtttaatggcgacaactaagcttgaaaacttatcacaaaatgctgttcttaagggatttgcaagactgatggtggactttccgggtccggttcgatcagtgacggttgatcacggtaaagagttttcctgcgatcaggcgcttacaaagcgctatcggataccggtttacttttgccacgcctatcacccgaatgaacggggcacaaatgaacggttcaatcgagaacttcgctactatttcccgaagggaacacagtttgatcaggtttcagagaccgatattcaacaagccacagcgcttatcaataacaaacctagaaaatgtctccgttggcaaaccccagttcaagcagtgagcaagcctctttctaggtggtaactttattattgcaatctaggtaattttcatgatgttaatcctcctcgggtgcagcgacagcttttgcgcgcatcttgcttaactttgccggattgagcgttagtgctgcaatgaaggcaaccccagctgtaaagactaagaacaaaaatgctgtagcgtacgagcctccggaaatttgaaccaaaataccgatgatgatgggggcaagaaaaccggatagttggccgccgaagttaacgatgccaacactggagccataagcttttttactgacaagttccgcaaatagtgcaaaagtaccagcaaaagcaatggatttgcagaaataggttaagatttcaaagatgatgactgccggcaatgcagtagatttgtacatcccgaacatcaatcctgttgccagcaagcttgcaacgccaataaacaatttctctttacctttgaaaaaccgggccatgatgtatcccgaaatcaatgagccggcacctgcagctagggacggtaggggtacgagccaagaaataccggctaaattaatatgacgtgctgctaataagtaagtcggcatccaggaatcaagcccctttgtgacagagctgaggccaaagacgatcaggaagaattgccataatacaccattggttaaaacggttttccatgggacgcgtttttgtgtcgcgtggcctgatgcttttaacctcgcttgctttcttggacgcagaatgatggcataaacaacgatgaagacgataccgagtaagcccattaggtggaaagcagtacgccagccagcatatgcaatgaccggggcgatcacaacaggcgcaatcgctgcaccaacataattcgatgaaattgtggctgaagtggcagaggctcttttgttgtagggcatggtttcgctaatctgtttaagactggcagaaggataggtaccttcgcctatgccaaaaagtatccgaatgataatcagggaagctaatgaccatgcaaagccagttaggatggtgaagagggaccacatggtgattgcaacgataatggtgcgataagtgccgaatttatcagtcaaccaacctcctggaatctgcatgaatgcatatgagaagaagaaggcactagcgacaacgccgagggttgctgtacttaagtgaagatcttgaccaatgtaagatagcgcaatactgatagcggaacggtcgatgaaacaaataatatagccgatatagaccatgatgaaggtaatggttccacgatgcgtctttactgctgattgcgtatattccattcagtttcctcttttctcgtaagtggtaattagtgaatggtgaaaaactctaaaagtgttttcataataggctttaccaatagttaagcgtataataagtgcaagcctcatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagttcccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcggattacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcaacctaaatcaccagccactaattagtgactcaatgaagtgaatactactgaaaaaagcctcctcggtaatattctcgttagctgcgtggttgttttgatcaaaatttgccagtggaacggtgaatactggtactcgaagaatatctgtccacacataattgggatcggttccgggcatcaccggttcaatgacaagtctgacctgtgaggcctgggccgcgtccttgaagtttgttaagtcaacgttacttgggtggacaacggttggcggtactttgccggtgatggcatatgtcagttttcctgttttcaaaaaggaagccagaatcttttcgatgcctgcttggatcacaggaatactttgggttccgacgagacgcatatcaatgctgacaaaggctgaaccaggaatgactgtcttgacatctgttcccgtgttgccagcggccatgccgttaatattgaaggttggttcatacatcaattttcgataataagtttgtttatcagtagtggtcagttgactatcaaaaacggtggtaattttctcggggtcgaatggtaaagcgtctatccacgaaagctcttggtcggtaggtgcgttgacgccctcgtaaaatcctggaattaatacgtgttgatgcgcgaaatcatatagctggttcaatgcttcatggagcacattgactgggttggcgatcacattacctgcgttaccagaatgattcgcgtgcgtcgcggtggttgaagtcaagcgtaaaccgaacaacccgcgatttcctaggcgcaaaacatgagcaccactggcattcatcgagccatccgtaacaaagacctttttgacgttgcgcagtagctcatttttttgactgcggacgagttccggcaaattaacgctgccttgctcttcctcgccttcaatcaagaattgaatggtgtaaggtaacttgggctgtttagcaagaaagttgctgatgccagttaatgtcgcgataagttggcctttgttgtctccggttccgcggccaaagaaacgattgtcccgtttggttaaagtgaaaggatcacttttccacgcggctaaattaccgggcgtcatgacgtcataatggccataaaagagtaatgcttctggccgttctccagcaactgttgcaaagatggccggtttacccgcggtgggaatcaaggttacttctgcaccgatgtttttttctaatatgtttacaattttttgcctagctgcatgttggtcttcatcgttagtgctgacgctgcgacaagcaattagttcttgtagcgcgttaactggcgaaatgataggttgcatgtcggtcgcctcctaaataagaacttaatgacgtcatcttattgcattctcatttaaaatggaaatacaatattagtcatacaccataacagttttgatataggaggtcggtaatatgcggttactgcaacttaattattttctcaatgtcgccgtcacgcagaacatctcaaggtcggcacgaacgctaaatgtgagtcaacccagcctaagccgcagtattcatgaattagaagccgagctcggtgtgccattgttcacccgtaacgggcattcgctagcactcaacgaagccggtcgccgttttgctgttcaagttcgagctggtttgaatgaggtgaatcatgccgtaagagacttacaccgattcagcgaaatcaattcaaatcaagtgacgttgcggtttgaaagttcgaccgccgttttacctggcctgctcggaaaacttgatgcaaaactgccaacggtcaagattcacctcatgcaaaatggtttcgaacaggatcgtttaagtcactacgattttgaatttacaacaaagccaatttttaatttttaataatcgtaattttcatcttttaaaagaagaaatcttagtgcggtttcccaagacgtatgacaatgcaaacaacaaagaggtgcgcccagaagagttagtcaagtggccgttaatcttgacggaatcgaacccgttacgtgaacagatgacttctatgctgcaccaagcaggggtaacggttcgtcctagttttgtgactggcgatcggcaaacgattcttggccttgttcgcaccggccaaggtatttgtttcatgccgcaatattcatgggctggcacggatgtttcagggacggtcggctatcactttgcaccggaacgggtatttcgtgatatttacttgagtgcaagcgaggccacgatgagactgccttatcggagggagattgcagagacgattcaacaatattttgccgatttagtcgcaggttgatgatctggcctttcccattaaagtttccagaatttcacgaatgcctgcagaaagcaatcaggttaatttaccaagaaaaaacgatggctgtctttgatgtcatctttttttatgtacaaatgttgttggaattatcccgaagaaatatctgtgataaatgcccatttaacaatgaattttggatacgagtgcaaactctaggtgattttttaactgaatgaataaccacaaaaaaacaacataacgacattttttagcaacaaagcgttacctttatgagctggtttgcccgtattatgaaagcgcaaataaaaatagcgagttaaccggtacttgcatgcaaaacgtatttattaggaggagcaacatgacaacagcaaaattgtgggaacaacctgaactaaccgatatcaatcggatggttcctcgtagccattttcagacattcttcccaggcgaggatagtcagccgcggaattatcagttattaaatgggacttggcagtttaagttcttggatgcgccggaatatgcgccggaaaatttcatgaacagcgactttgatgatcaggattgggatcaaattcctgtacctagcaattggcagctgcaaggttatggcaagatgcattattctgatctgtggtataacttcccaatcaatccgccctttgtaccgagtgaaaatccaactgggttgtatcggcgaacctttacggtggatgaggtagttgataacgaacaatacatcattggcttcgatggggcagattcggcttttaagttgtaccttaacggcgagtttatcggctatagcaaaggtgcccgtttgccaagtgagtttgatgtcacgcaggcattaaaacaaggtgttaatacaattgccgttgaagtggttcaatggtctgatggtacgtatcttgaagaccaggatatgtggtggttgagcggcttgttccgtgatgtgagtttgtattcgcgaccacaaaacgggttatatgatgtgcaggtacgaacctatttattgaaggattatcgtgcgggtgaactagtcgtcacaccgatagtatccgggacggagccgttaaagattcattatgaactagccaaagacggggctaaattgattgaccaagttctttctgccgatgcttctttggatgtcacgctggacgacattcaggcgtggtctgctgaagcgcctaatctttatgatttaacgatgacagtgttgcaagataatgagccgcttgaagtggttcgtcagcgggtcgggttccgccaaattgagttgaatggcaagacgttcttggtcaatggcaaagcaatcaagtttaaaggcgtcaacatgcatgattacagcgctaccaagggccgagtgatgacgcggaatgattttgttaagaacatcagcctgatgaaacaaaacaatatcaatgcgattcgaacgtctcactaccctaaagcaccgtatttctacgacctgtgcgatgaacttggtatgtatgtcattgatgaaacagatttggaatgtcacggctttgagttgactgaacgctatgattggattaccgatgatccacgctggaagactgcatatgtagatcggatgcggcggactttgcaacgcgataagaatcatccttccattatcatttggtcgttaggcaatgaatcagactttggcgataattttcgggcgatggctgcatattgtaagcgagaggatccaacgcgactcgtccattacgaaggtgattttgaagctgaagtcagcgacgtttattcaacaatgtacacgtggttggaacacgatactaagatgacaatggcagatgtattacgtaagacgcagaagccccatatcttatgcgaatatgcacactctatgggcaatgggcctggcaacttgaaggaataccaggatctcttttacggacatgaacaactgcaaggtggattcatctgggaatggtttgatcaaggggtagcatcgcaaaaggatggtcaaacctactatcgttatggtggtgactttggcgatcagcccaataacggaaacttttgtatagatgggttgatccgcccagatggcaatccgtctacggctttaaccgaggtcaagaagacgtttgaaccgttccagatccttgttcgtgatctgccaacgcaaacggttacggtgattaatcgactggactttctaaattctgattactttgattttggttatgaacttgaagcaaatggtcaagtgattgctgatggcaagcttgatatcccaactattttgccaggtcaccaacagaccgtgaaacttaatctcgatttgccggagtttgaccctagtgtcatttataaccttcatttggttacgcatctcaaaaacaagactgcttgggcgaatgctggaacagtgctttctcaatctgtcatgaccttgcaacggccaaaacaccaattgaaccatcagacaatcgtggcactacaagcaagtgaaaataaaacgacaatcgaaatcaaaggcggtgcgaatgcataccggtttgacaagattaaaggtaccttcacattgacacatgatggtcgtgtcctgattcatgatggcatcaaaatgaatttctggcgcgcccctatcgacaacgacatgtatctgttagatgactattacaacaaatatttcctgaacctatggcatgaaagtacccgcgaagtccaattacagccgcaaaccaacggcgattatgtcgttaatctagtcaagcaagtgggcacgaccaatagtggctggtattaccaaatcacacaacgctacacattacatcaggatggaagttttgatcttgatgtgattggtaaggcaagtggcaaacgtgacatggcaccagagatgctaccgcgaattggggtaaagatgacgttgccaaaagatttccagcaagttgcctatgacggactgggaccaactgaaaactatagtgactctcatcaagctgcctactacagtcattttacgagtcgggttgatgacctctttgtcaattatgtaaaaccgcaagaaaatggtaatcatatggacactgatcgattagcactgatgaacggtcaggatcaattaaccttgacgatgatgaagccattgaacttcagtgtgtcaaactatgcggacgaaactttggaggccgcaaaacacaccattgatttgaagaaatcagatgagctcaatctatatcttgatttccggcaaaacggacttggcacgaactcgtgcggccaaaatcaattaaagcgtcatcgctgcaagtttgatgattttgaacttggatttaacttcaagatcaactagtggaggagtttcaaggaaggaagtgttctacgatgtcagaggataaatcgcgacaacgactggggtctgccgcattgatgttaatgacattctcggcggtgtttgcttttccaagtatcgtcaacaatagtattcaaattggattggcaacgattccgggctacatcttcgggagtctcttttactttttgccgtttattttaatgattgccgagtttgcatcggctaactccgacaaagaatcaggagttcatagctggctggaaagtgtgttgggaagtaagtttgcctttctgggcgcttggtcatactttttcgttaacttgttcttctttgtttcattgttaccaaacacattaatttatggttcgtatgctttgctcggccataatgtgtttggtggcgcgatgggtaccaagattatctcggttctctcgatcgtgttattttggttggcgacctgggtctgcatcaaaggggtctcttggatctcaactgtgacgaattttgctggtactgcgcgacttctaatgggggttatcttcgttgtccttgcctttatcgttgtgatggggatgggtgaaaaaccagcacaagattttagcatgaaggcaatcacgcctacctttaactggacattcttcatgacaatggcgtggatattacaagctgttgggggtggcgaaagtattggtgtctacattaaggatacgaagggtggcaataagacatttgtacgtaccatgattatttccacccttgtcgttggcctgatgtatgttctcggtgctattgctgtcgggtttgtggttcctaagtcagttttggcgggcaacttctcaaacgggatctttgatattttcaaaatcctaggaacgcatttcaatattcctggtaacgtgatggtccgacttgtaggcttgattctctttgtgggtagtttaggctcgttggcattgtggacagccgcgccagtcaaagtcttcttctcagaaattcctgaaggtgtctttggtaaatggttggttaagaccaatgatgaaggcaatccaacaaatgcccttctggttcagggtgtggttgtgactttactcatgattgtgccagcactggggattggtaatctcgacagtttcttagagactttgatcaacatgactgcggcaacttctttactgccagttctatttctgctaattgcatatattggtttacgctggaagaaagatgatatgccacgtgatttccgcttcggcaatcggacgatggggttgacagcaggcatcttcctcttatgtgttttcctctttgtcttcttcatgtcaaccgttccggatccacacttgatcgctgaagaattggcgggacatttaccaaaaggaacagcaagtccaattggaacgctgctatataacgttctcggagttgttatctttatgggggttgcttggatttactgggatcgttacgaaaagcgagaacgactcgcaaaggctaaaccagttgttcattaaagacaactctgatcgggaaactcgggcgtgataaacgatcagccaacacgcacgtagcaccgcagactgctcttgacgtttggaatacgtaatgtacatgaccacctcagaataggaggtggtttatgtgcgtaaaaggagtctacattggcgcaaatagcatctacacaagtcaaacgagttttaaaaacacgacatttgtctatgatcgcccttggtggcagtattggcacaggcctgttcgtcgcaagcggtagtgccatcgcaactgcgggtcccggtggcgctattgccgcttacattggcattggactaatggtctttttcctaatgacaagtcttggtgagatggcaacctatgcaccggtttctggttcgttttcagaatatgctagtcgcttcgttgacccagcacttggctttgctttgggatggaattactggcttaactgggcaattacattggctgttgatgtttcgacaaccgctattgtcatgcacttttgggtgccaaacgtacctgggtggctcatttcggtaacgtttttaagtcttatctttgtgattaatttgatttcagctaagtcgtttgccgaaacggagtactggctgtcattggtgaaggtgatcaccgtcattgtttttctcggtgttggtttgttgaccattgtcggtatcatgggtgaaacagcgacgccgattgggttgaaaaactatacgttgggtgatgcgccgtttgtgggtgggttacctgctacattgtcggtgtttgttgtcgctggtttttcttttcaaggaacagaattgattggcattacagccggggaaagcgagacgccagagacgagcattcccaaagcaattaaacaggttttttggcggatcttgttgttctatatcttatcaattgccgtcattgctgcgattattccgtacactaatcctaacttgttgagcggctcggtcaaaaatgttgccgtttctccatttacgctagtatttaatcgcatcggtatggccggagcagccagtctgatgaatgccgtcatcttgacttcggtgctttcatcggcaaactctggcatgtatgcatcaacgcgcatgctatgggccatggggagttctggatttgcaccccgtatttttcagaaaacaaatggccgcggtgtcccaattgcggcgctgcttttgacgacggtgattggtgcactgacctttttgactagcattatggggccgagtgtttatcagctactagttgccgcatcaggactaaccggtttcttagcttggttgggtattgccgtgtcgcatttacgatttcggcgtgctttcgttaaacaaggacattcggtgaaggagcttcgatatcatgctaagtggtttccagttggccctattctggcgattatgatgagtctgattgtgattgtcggacaagacatgagttcattagctgatttccaatggggtaaactactaatttcatatatgtcgataccaatttttctcattttgttcgtttattacaaagtgaagcacaagactaaactaatcccgcttgatcaaattgatttggcttcgcatcatgatcagcgtggctaagcggagttggctgacaacttggcttgttgatacatggataaatagaaactcaaggttgaatggcgttatcattcaatcttgagttagtcatatttgatgaagcagccatgacaagtctagcaacgaggctcgtgtggctgcttttttgtagctgaaggaagtggctttagaaagtaaatttgaaaccttggaaaatgaacctttttaatttgattgcgtgttaagctgtaggtatgtaagcgctacagaaagaaacgggatctaattatgtttaaagaaaacaagtggctgagaacagatcgcattgtttgtcctgagctttcggtatttgaagtgggttatgaagatgttcatccgcgagcaccgtatcaatatgaacagcttgattactatttacttcattttgttttgcaaggtgagggactattttttattaacaatgaaattcatcagttgtcacgaggacaaggctttttgattccgcctcatacggacaacaattactatccattagttggcaatccgtggagttatcgatggattggcgtcagaggacccggtgccgcggctgtctttaatgacgctgggctaggcaagaccaactttatttaccagcaccaggatattcatcaaatggacgacttatttgcagaagcctacgattattttagccgcgatcacttgtatggcgcattgggcaagttctatgagattgttagcgcattggtggatgattaccagcaggaaacacggctaggggtcttgcctaatcagcaatacgctttggaggcagtcgaaattcttaaaagagagtatgcagatagtacgttgcgaatagatgacgttgccgagcgagtgaaagttgaacgtacgtatctgtatcgtatcttcatgaggaatcttggtgtttcacccaagagttacctcatgcaattgcggattaaccaggccattgaactattacgaaatacgaatgatgcaattggcgacattgccatcaaagtagggtttaccagttactcgcagttttcaaaagcgtttgtgaaggcacgccgaatgaccccatctgcttttagaaaagcgatttcgagtggtaaattaaatccgcggaaaattgactgagcatggctattcagtgattggtttgtgtatttatgggttattagggataaggcagaaacttttcagagctttaaaacacgaaaggagaacgtgatgctcaagatcagcttcaatcgagttgtggcggggcggtcatgtaaccacgaggatgaaccgaattgtgcatgtcgacattcaagaaatcgtcagggaagagacaataacccatgattggcgaatttatttgcttttggagggggcggctaaagcgaatgtctttcagtctaattacgagttgaccaagaatgattttttaattctgaatcccaatgaacgattctcgatgcattctgtggagccagcgttagtgctcgctatcaccttcaatgcggtccatttggatgatatcttgccgggaatcagaaaacagcgattttggaattttcctagttcttctgctgaccagacgactgacagtattgatgaatgtcgccagttgttgcatcgtatcatgatcacgagtctttttgaagatgtcgatgatgcggcgattatcgcaagagggttggcgctaataagctatttgcgttcgcattatctttggcacgagaagacccgaagcaatgctggaacagatcagttagtgaatcgcgtgatcgcaaaactggagtccgaatatgcggaagatgtcaatttggcgtcattggccagtgatatgcatgtctcatacagttatctatccaagcgatttaaggagacaacccaacttaattttaaccattatctcaatgcaatccggttgcatcatattgaacaggatctaaagtacacggataaaagcatcactcaagtaggtattgacaatggctttagtcagccgcgtacaatggcacgtaattttcaaaaacaatatggcatgtcaccacagaaatttcgccaagcatttgcgaccaccaaaatgttgccgatgcatagcgggtctcaggttacaacattggggcgtgatgaagcgctcagtcgtttagctgggaaacttgctgacgacgatttagcatccttacaaccagcaaagttccagcagaaagtcctagaagtacagtcagttaaaccgctgcagcgaaaagcggtaacttatgccatcaatgtcggcaatgtattgaatctcaaccagcaagaatgcgttgcgcagttgaagatgctgacaaaagaagtcgtcattgcctacatcagggtgtttgaccttgataaggttaacatcaggccaaattatagctcggtcgtgactgctgacaaggaattaatcactgcatttcatacgattcttgcctttggcgcgctaccaattattagagtgtcaccgaacatcgtggcgcatcagagtccggaagacattgtggcgcgttttgatgccatcgtccgggcatttgggaaaagtgttgtgcgcaaatggattattgagtttgagtatgactgtttgtgtagcgatgacccggatgttcagagggtaattaattattttatccatcatgcggcctggcatcggattggcgtgcatgttactgaacaaaatgtcaaacaaggtaaggacgtcacggttcacacacttgggaatcgttttgtttacttatcttgtgattacctatttcttcggcatgaaatcaaagcagatctagccggactcgggtcgcaacttgaagcgattcgagcaagactcgcacccaatcaagcatatgcacctgagttggccctagatgactggaataccttagctggtagtgacgaggtaacggtcgggactttctttagagctgcactgatcaaagaaattttgcgacaaaatactggccttgataatatcagtttttggctaagtatttccagtcgggctagcgtcatacccactgccacggatgattgtctatcgttatttctgtatgggactattcggcggccggtttattttgttatcaggatgcttaactctctgatcggcgagtgtctttatagttcaccctactttagttgttttcgaaatggtgaagattatgcgctcctattatcaaacccgacgtatgttgacccgcgcatgtctatcagtgatagtctgatgcagtatcaatctcagaaattacagttgcaacttttgggattggcatcttcgcggtatcgagttgtcagcgaattattggataaggactgtggtggcatctataatcaatggcttaaagtcggtgcgatgacaagttattcgaaaagagacattaagtacctggagacgatcacgcagccgagattaaagattaagcttgttgaggcgacagacgggaagctaactttggctgccacacaatcgtttaatagtattcagatttaccacgttagtccggtgatggattaaatagatactgaccttgaatcgcccctgtccgtgttctggataggggcatttttcttgaattttaatcggcataaagtcggtgcaaaaattgtccgacaattctagcagaaaaattaagaggttgataatagacacatgtaagcgctttataaagacgaacaatatcctacttgtttagagatgtccacttaaaatggaaacatgatcaaaattctttaaaggtgggtgacaacatggcgacggttattggtaaaacgtctcgatcatcagaagcaatgctcatcacgtcactgatggcgggctactcgatggtttatatggacaagagcatgatctcaacggcgattattccaatagcttcagagtttcacttcaattccggtcagactggtttgatgatgtcgatgtttttcctcggctattcattgatgcaaattcctagtggatggttggctgatcggttcggttcaaagcgggttcttatggcttcgttgcttattattgccagcttttcctttctgtttggggtggcaaacggcttgctatttttcattttcgtccgcttctgtgcaggactagggcatggcggttatcctccgagttgctcaaaagccattgcagaaaactttccaaaggagcggcggacttttgtgcaatcattgatcctttcgacctcgggaattggcggtatcttagcctttacacttggcgcacgtttggttgatagtaattggcactatgcgtattttgctatgggcacgctcttcttagttgcgtgtttattcgtttggcgattcgttcccaaaggccaacaagcaaatagcaaacaggatgaacaaagtgaaaagccgagtttttttgcaatgttaaagaatcgcaatgtactagttttgtttgtggcaatgttgttactgaacgtcttgctatacgggaacatgtcatggctgccatcgtatataacgtcaacatttgatcttactattagccaggctggtatgatcctagccttgaacgctgtctttcaaaccatagcgactatctttgccggtcaattactttccaagttgtttttgcataaagaaaaacgactcattttaatggctaccttaatagtggctgcgttgttaattgcgttcgtcatgtcgagcaacttatatgtttcggtcgtattattactgcttatcaatatgattagtgtcacagcctttacagcgatctttacttggccgcataaaatcatggatgcgggcattattggctcatcgattgggattatcaatacaggcgggaccttaggaggattcttggcgccgatggtgatcggttttctcgtacaagcagctaaaggatcatttgtgccagctttcttctttatggcagtgatgagcctgctgtgtggtatgacagttattgcggttaaaacaaaagcataaagtaaattaggaggaagagaaaaatggatgctaaagaacggttgatgcaaattgttgaagagaaaaaagatgaatttatcaaagcttccgatcagatttggagcacaccagaaaccaggtttgcagttgaaaagtcagttcaaccgtactatgagatcttggaaaaagaaggtttcacgatcaaaaagggtattgctgacatggactatgcttttgaggcgacttggggttcaggtaagcctgtcatcggcatgttggcagaatatgatgcattggggaatctgagtcaagtggcgggggaggtcgaacacaaaccgcttgttgcgggtggcaacggtcacggatgtgggcataacgtgttgggcactgctgcacttgccggagcggtggccattaaaaccctaatggaagaagagcacctttctggcacgattaaattattcggctgtccggctgaagaaagtggctacggtaaagcttttatggccagagatggcatttttaacgaccttgatctagcgttggccaatcacccgatggactcaatgtcaggatggggcagcagcagtcttgccgtgcttcagtgttactacgaattttctggcacaccggcgcatgctgcagcggcaccggaaatgggacgtagcgctttagatgctgccgaactcatgaatgtcggtgttcaatttttacgcgaacacatcattgatccggccagaattcattatgcgttcattgatgccggtggcgagtccgccaatgttgttcaaccaagtgcaaaactgtattacttcatccgtgcgcctcacgttgatcaggcaaaagccatttttgccagagttaacaagattgcagaaggggctgcgttaatgacagagacaaagctcactaaagagttcgatgcaggatgttctgattttgttgcaaataaaccattaacccgagccattgacaagaatcttgatattgtggggcctttagagctgaccgatgacgaaatggcctttgaaaagaagctttctgacacagcttccgaggcaagtaagcaaaactcatataaccgcgccaaacattctttcccagactggaccgaggaacaggtaagaaaagaagcagaagccggcattgctttgcataagctaccgttagaatttactgacgaaacggctggatccacagatgtaggcgatgtcagccaggttgttcccacggctcaatttacgaatggttttgaaccccaaggaacatcgccgcatacatggcaatgggtctcaaatggcatttcgagtgtggcccataaaggcttattgttaggcggtaaagtctttgcattgacagcatatgatgcactgactaatccagatctggtagaagatgccaaaaaagactttgaagagcattttgcgggtaagcaattcgaatcgccaatcccagctgaagtaaagccgcggtaattaaaagatcggctctcaatgggccgatcttttaattaccaatttataaattttagagtttatccggtgtgcttttttggcaaattcagtcaagatcgttcgccgggttattactttgaacagcagcgatagtctctgaattgatgaatctcagatcgggttctggcacttgatcaaaaacggcatgcgcaaaggttgccaacttttgactataaggcaatggtacgctgagaatcttacctagtctaaccagtggatcaattccataagggagatcttcaataataaaacgggattgtatgttggtaggtgctggcaagttacgataagtagccaatccgtggaacacttcgccgagcgtgtcaaagtcagtcccccattgtgttgccaattgatgcacaatgctactgtaaggaatatctaaaacactagctagttgtttacgctcagtatcgatgcgcataatgtaggctctggtggattcactcaatccatcagtcagaatgtggaagcgttctgcatgttcgattcgaggaagattaaaaagtgagactggaacatgaataataggattgagcgcactaaggctggtctgcaagacgctaggggatacactaatttcggaataaagctgctttagtaaatttaaaccttttcgccaagcttgctgattgccatatgctgccacggtcacttttgttttaatttcactgatgtgtagcgaatgattatgccattgagcaacgtaaggcatgccagaagtctccaggatgctgacatgtttttggataatccagtctggcgtcaattttgcgacagcttgcaacatgccccagttgccatttagaaaaataatggtttggtcttgatggatgaacggcttgatagctgaaatgatatcctcatgtgcattcgcccaggttgcaatgatgatgatatcggcaaagttaacgctggcagctaggttggcgctcactcggaattgcgttgtggttgtgatacgccccgtgatagtaaaagagcatttagttagcttggctgctttaacagggtcccgagaaaatattgttgtttctataccacgtcgcttaagatccgatgcgcacgcaaagccggtattcccagcgcctataatagtcaccttcatactttggcctcctcactggccgcttttaagaatgcggctgtttcttggtgagatggatgcttgaagaattgttcagcaggggcaacctcaactaaattgccttcatgtaaaaaggcacatttggttgcgatatgctgggcaaagtcaagctgatgggtgacaacaatcatggtttgacctttagcgcgtaaagataagatatctcgggtaattgttccgaccaatgcggggtctaatgagctagtaggttcatcaaagagaatgattgaaggtcttaaagcttctgcacgggcaatgccaatacgttgctgctggccacctgacagttctgcaggataaagatttgctttatccgttaattcgagttgtgcaagcaaagtttcagctatcttttttgcgttactctttgtttgatgctgcccataaatcaaaggctcagtaatattctctagcgcagtcttattattaaatagcgcatagttttgaaaaaccattgcaagttgatcacgaattgagcgaatatcactggcggttagatggcgataatcgaaggtttttccccccaacgttagatggccactggtgggttgttccaacaagtccaagcatcttagaagagttgtttttcctgcaccacttttgccaacgatcaccaatgtttcaccagaatttactgttaggttgagatctgaaagaattttcttacctttaaattttttggtgagttctcggatttctaacaacggcatcatcaccacctacttttcttgggcataagatttggttacatctgttacgcgatcatttttggctgtaaaaggatcactccctagccatttctgagacagcttagcaagtgtcccgtttttgcgtaatttagtcagctccttatcaatgtcttgacgtagctgagtgttgcctgcgttcttgtgatagtaataaaccactggaaagaccgcgatagacttggaaagcttcaacggttcgtttagtttcttttgtgcggtatcgaagtttgttcggggataaagaatcgcatcatactgtttattgacaatatctttaaactgattagcggtgtcgacaaagccagatgatttcagcgcaactttttgatcaggatgtttcttattccagtcttcaacgatgccatatcgcggatcggaaacatcaattggttcgagtttgccgttggtttttgcaagagtagccagattggtgatttgattgtcatctttacgcactaccaagcgtaaatcactgagtagagtggggcgccgtgaataatcataggtttttgcgcgttcggatgagtaatagtagtttcccacggctagatcgtatttgcctgattgcaaaccgacaaatacggagttgggatcagtgacctgatattgaaacttatatttactttttagatctttttgaatggctgccagaatagctccgttgtatccggataattcatccttacttttgtagatttgataaggttgagaggcagaaggcccaacgatttgaacagttttaacctttgaattgttgtttgcattgccagagctagacttgccgcatgagacaaggaaaaacgcgaggatggcagacccaacgatgaatgcgagctgagattttttcatgatgtttactccttcaatgtaagtatgtgatttgtttctttatgagatggaagatggcgctaactaaccaatacaagatgagataaatcgtccaagctgctaaataagcaggaatgaactgatacgtcttggaaccaacgaggatactagtccctgttatttccagtaatccaatgttgtaaataatagcggtacctttgacgatatccatcacgctattaaagacatttggcagtgccagtgcggctgcttgtggtaagatgattctgcgcattgcggtcatcttgctcagacctgaagcaagtgctgcttcaagttgggtcggatccaaggcttgataggctgcccgaaatgtttcaccgaaataagcacttgaaaatagtgccaatgcggccacagcaaccactgtagccgggatgtggagtcctttaccattatttaacatggacgttaagtttggtaaggcgaaatacagaatgtagagaacgacaatcattggaacactacgggcaaatgaaaggtagacacccacgatctgattcagtattgggaaatgtttgattcgtgtccaagctatcagacaaccgattgggatcccacagataattgctatgatagcaatgtagatacttatccaggcactaggaagaatttgttgccagtcttgccagaaaatagtcattgtgcacccccagaccaagcgcgccgacgttcaagttgggcgaagagtgcctgaatggcaatacagattatccagtaaatgagcgataacgcgataaacactatcacttggtttttcccaaaagatgcttgagcaattacctgggcttgctcgtaaaggtcagtaattccaatgacataaacataggccgagtttttgacaatcgtgatcagtgtatttccaatattgggtagtgctgcaacaaagatctgcgggcctagtattctacggacagcattgaatcgactgaaatggagcgatgtgcacgcatcgtattgtgattgggggaccgaggcataggcactgcaaaggttttctgcaaagtacgcactgttttccaagccaatagccaagattgcaaaactagtttttgcccaccatgaaatatcaataccaaccagttgggataagaatggcatgccataaaataccagcatcaataacaataaaaccggcgttgcacgcataagactaacgaatccgttgtagagaaacttccaaccaacccaattagtaaagtaagttaatgaaatgagcccaccgaaaactaaaacaaaaatcgccgatgccccgatgatccaaaatgtgatacctaagtatggaatcaattgctgaaaaaccttaacaaatgtcgcgaaccccactactatcagctcctctaaaaataaaaaggtcttcgtctctgtatatttaaatacagggacgaagaccttttcgtggtaccacccttattcttgacgagattgctccagtcaactcaacaacacctaaaatatcgatgtttgggacgatatcgagtcctgtcgtggccatcgcttgcacgatgaccagtgctccgagttcatcttcggcgcttcgccgttccaccttcacacctaccggcagtctctttaaacggtttcacgcttactcttctcttccacgcacagatttatataatgatttgattaattgaacatgagtatattgcttccagattagaaagtcaatcgattttttagacagtaattagagatgaaaattaatatctgctttttcaatccaaagtcaggggttatagttccagatgaattatttgtttcgacaattgccagtgaaaagactttggcctatcagaccccatccccacccaaccctgcatcccacccagcctgcagccgatactcctcctccccaacaacctgcttagccccaaaataagcctcgcgttgatgcgtcgcgttcatcagtgtccgagccatcgtcgtagtgaccacaatgtgatgttgctgccggtcatcctttgtcagcggcaagttgccttcagcgatgcgtgccagttgactgataacgtccatcaacaagttgctgccggttaaaatttcgccaaaacgtgcggcgtgatacgtggtgggtaaggaaagtgagcggcttttttggaagcggacggtgacgattcgttgatgctgccggtttgtgatggcgtaatcaacaagccggtgggtcgcgatccaaccgacattgcggtgatcgggagccgctagcggcatgaaggcgtagcacggaccggtgagcatcttgggcagttttttggcggtcccgtgatataatttctgcacgataacttggcgcatcgttggggagtaaaccgaactgttttcgtgcgaacgaatgaaacctaacgtcgatggcttgatcaggtgtgccgcagtggccgtgagtatcagcgtttttcggggaaggaaggacgctggtaaagggagaatcgccaaaatctcctttaacggcaactgcgaggcgtctgatgctgtggcgttatgggcgagttcagtcacgagatagtcgggatcatctggagcggttttgaccatagccgcgttatgtatggctcaattttagtttaaacttatgctaattaaaagctgaaaatgttaaacgcggtgaatttatggcgcaaaatcgcgacaggtgttcaggaaatggcaacaaattgtctagtattggctgattttatcgagcttaggaggtaattgggcgaggagcgaggtgggtgtgttatgtatgaagctgcctttttggtgtgagcgtgagtcagcccaggttggctcacgcgttatggtgtgacgtgacaaggtaactgaaaaagtcgatacttaatgaaaaacgcgtccggctgcgacacccggatgcgttttttgatgggcgtgagccggcgtggttagggatcggagtataagtggtcttggtcgtgatgacggggttttggccattgcgaccaagatcctgacacgcagattcctgtgccggtgaacgcgttaagaagcgtgtattttgatggaagtgcgatccgatgaggtgaaaagtcggggagcacttttttaaatgcaaaaaaaagttagctgaaaatttcgcgcaatttatgtttgaaaaggcgataaacccaggcctgcacagataaatacccgcactcactaaatcgaaagcttgatagaacaggttttcactcatctgattgcgaccaagacgaatcactgcttgcctcgttaaactaaccttatcgatatcgaaacaaacaaggcgccggatcggatgaagtgatggtaacagaagcgacaggttttgatttttttcttgcgcatcaaggagtggtttatggggcgttggcgcggttggggattcatcgtggccgcagtgattttcaggattggcgggatgaagggatgttggtgtatctcaactacttcaaccgttatcgcgagccgttggtggatgaggcggcgattgcaaagttcaataagttggcgtggcgtttcgtgtttctgaccttgatgcagcggctgcaaaaagcgcagcatcggcgggagttggaaaacgtaccggcaaatacgacgcatattcaaacgaccacgctggcgatagcgccggggagcttgcaacaagcgctggaattgaagtggcagttgcagcagttgcacaggctgttaaccccgatggaacgccatgtgttgcagttgcggttaagcggattgtcagatgctgccattgccgcccaactgcatgtcagtcggcagcggattttgcaggtgcgcaaacgggtgcaggcaaaataccgggcgctgagtcaaaactgtgcctcggtttaaccgaaatgggatgcgcgattgcgaaagactgtagcaaaacgctgcgttcctatccgcatgctgaagatagctgcaaatcagcgacaatcaattaacttttatggaggataacgcaaatggataaagaactattgacgtatgtattagatcaggcggtcggcgtcgtcattgccgtgattttactcacgcgcattgaacggcgactcgacacactgattacacatatcgagacgttcatggccaagcttgatggcaagcaattacggtaggaggggaaaagatggcgatgttaatggcagatgtaagcagttggcagccggattcggatagctggtttcgcaagttggctgatctaggcgtcaaggcggtggtcgtcaaactgacagaaggaacgacttaccagaatcctaaggcggcggcacagttggcggctgggcgcaggatggggatgcaggtgcacgcttatcactatgcccattttcataacagtgccgaagcggtggcagaagggcgtttcttcggtgtcacggcgcgtgcgctgggggtgtcgacgcaaagtgtgatggcggcggatgttgaagcacctgatttgaccggagagctgacggggttgacgaatgttttcattcagacggtcaaagcgctagggtatccgcacacagatttgtatacaatggcgaactggatgaaaaccagacgctttgatcgtgtggccttgattcccaagaatttatggatcgcgagttatggcgttgatcagccgggcatcgataatgtcgggacctggcagtttaccaataactttcatggtttaggggtggatatgagttatgactttttcggtcactacaccacgcgcttgaccggcaatctcaatggcggcgtggcgctcgttcccacgattcgctatcacacggttttggcaggcgaaagctggtgggcgattgcggatcgatatgggttgaatatgtacaagctcgcggccctcaatggtaagacgatttacagcgtgattcatccgggcgatcagttgcggttgaattaaagcaagagaaattgttaatttttattgcgaattggggatctaaagtctctgagatttaaaagatcagctaaaaataaaggcgaacgagttttcctacataagctatcacaaatatatgcaatagctgtgggaaaagtcattcgcttttactttgtgctcttcattttttcctatctggattattcagggattgtaaagactagggctggagcggtaaatgttaattaacttgactccatttgatctttaaattggtttcgattagatttccattgtctaatgcaaaaggctcaacaaccgtgtgcccactgctgtcagtaaattgaatattgaggatgtttccggatcggtaaactattttccacgtgccagaagtggattttccatttgttgttgagctataagtaccgtcatcgttgaagtcaaatgtggttgcatcaccagactgccagtgcccagtgataccggaagatgaggtgttattatttcgcaatgaagtattggaaggatagttcttagtggttttaacaacaccgtggtcaatgtaatcctcattgctaaccgtagccgctgatggatctgtatcctcttcatattgtgaggtctcggcatcatcttcagaatcataacttgtctcttctaccgaattagcgtcactgttgctactactttcagatgtaacggcaggcgttacttgaccaggttgtcctgaaccagaagctgatgaggcactatggaaataaagtgctaaaaatgatacggcgatcaaagctataactaaaaatacgaaacttaaaattatacggttacgatgtttttgcttttcttcatacagaattcgctgtaattcagatctaaccgcaacatttggtgctttggcgatttctattctcagctgcatgatacgatcttggtatttttcattagcgattgtagcggaaagctgttctaaatccgcatgttgttgttgcgcataaaaatcattggaagaattatattgattaggatcataccccattttccccacctccaaaaacattatatcagttattttataacggctggtgaaattcggtttgtttcccaataatcaaggagccgcaaattcctacttttcagaatgtttttacaatgttgcataaattaaagttgacaccgtgtcactatccgtgtagactacaaattgttgaacggtgacacggtgtcaccatgcgtactcgtcaccaccaaggtttaaccgtggcggcgaaagcttaaggaggatcaacatggttttagcaacgttccaacatttagatcaaacaaaacagcaacgggttctggctgcgttggtgaccgaattttcgcagcatccgttggcacaggcgcaggtggcgcggattgtgaagcaggccgacattgcgcgtggggcattttataaatatttcagtgatttaaaagatgcgtatcaatatgcttttaaagccgtgatcgggcggttgcatacgggcattgcgggtccggaaatgcggcgtgatccgtatgctgccaccgcggcgttcttgcacgaagcggatgaaagtcaggatcgtgattttatccgcatgcattttaccaagaatagcgggttggtgacggttgggcagcccccgattccggccaatgcgattgaatgggcggtggcgaccttatgccacagcgcgatttccgaggcgctggccaacccagaacagacggatttgattttgaagcatctaaaagcagcacttaaccagctgcaagtgaaggagtagtgagtcgatgtatctctcattaaaagaaatctggcatgaaaaattacgttatggcttaattatcgccatgattctgctggtcacctatctggtgttcattctcagcgcgctggcaaacgggctggcgcagcaaaatacccaggcgattgaatcctgggacacgtcccgagtcgttttggccaaggattccgatattaacttaagccagtccttgttgacgtctgaacagaccaagaatctcaagctaggtaaaagtcaggcttatgtcggaacaatcggcgcggtggcaacgagcagccagcacaaagaaatccgctccacgatgattggtttggattggaatcaatatattggcaaggacatgaagctggtcagtggtcaccgggttcaaaacgatcatcaagtggtggtggacacacaattcaagaatgaaggttacgcgcttggcgacaagattcgcttgagtaccaaaggcgatcgctacaccattgtcgggtttacccagaatgccaagatgagtgtggcgccggtggtctatggcaccatgaccacctggcgtaccttgcacaatctgccaaccagttttaccgccagtgggatcatctccaagacggccgattttaaaatcaacaccagcgacctcaagacgtattcagccaacacgtttattcagaaactcccagggtattcggcgcaaaatagcacctttacctttatgattgggttcctgtttgtcatttcactgatcgtcattgctgttttcctgtacattttgaccatgcaaaaactgccaaactacgcggtattgcgggcccaaggtgtaccagcacggaccttggttgcgaccacgattgatcaggcactgattttagtcagtctgggactcgtcttaggcggcgcattgacggcgattaccgccaagttcatgccgctgggtgtgccgatgattttctcggcgggactcagtattgccgtcatcttaggcatcctgctcaccggttttctcggtgcgattatccctgtacgcaccatcttaaaagttgatcctgttaccgctattggaggttgatgatatgccagcaatcgaattaaaaaacatcattaaaaactttaaaacgccaaccagtgacgttgaagtactcaagaacgtcaatttcagtgccgatgccggcagtctctcactggtactcgggccatctggatccgggaaaagcaccttcctaaccattgccgggggaattcaaaccccgactgacgggattgtgaccacagccggggaaaatctggaacaactttctggtaaagcgcgggatgcgttgcggttagataaaatcggctttgttctacagtcttataatttggtgccgtatttaacagtcggcgagcagtttaagctggtcgataaaatcaaaccaaaagggaaccttagtcaggcagccctttctgagttgttggatgatttgggtattgccaacttagtcaatcagtatccagcatcgttatcaggcggccaaacccagcgtgttgcgattgcgcgggcgctttatccggatccggcgattgtactggcggatgaaccgactgcggcactcgatagcccgcgggtggcagtggttggccagttgttggctgatcttgcccacaagcataacaaagcgattgttgtcgtgacccacgatgttcgccttgaaaagtttgctgatcggaagtttacacttttggatggcaagttacgtgaaggcgaaccggagtatgcggcataaggctgtgcgtctttaaccttcatgaccatcatcgtgcagatctctaagcgcgccagttcacgctcaccataacgcgttcgccagcccagaaacctgcatgtaaggaccttaaccacaatggccaaagaccggccattgtggttaaggccacttacactccggtttcagaccgggctggctcacgctcactcaaaaaagaccaagctcactaaatcagtgaaatcttggtctttttgcatggctgatgattaaaagaggaaacaatgttgcagtaggattagcaactgactagaagcgtggttcacctagtgcgtgttgagcggcgaggttgagcaggctccattgccggtcgaatcctggctggaagaagaagtcggcttcagctaagtcttccaacgtgaggccgtattgaatggctagggccaaaacgttgccttgcgcggtgacgtcgtaagtggacagaactgcgcctccaagcagccggtgcgtttgcggatcaaagacaaggttgacgcaaacttgcggattaccattagcttccggaacataagccggacgcagggaatcagcgtaaaaagcggtgtcgacttggacatttgagcgtccggcagtgaacgtatttaagccgcttgctgcaaagtggtaatcaaacacactcaacgcgctggaaccgacaacgccgccaaacggacgtgccggatgttctgcaaagatattagccgccagataacgggcttcacgccgcgcaactgttgccaaggcaatcggaactttttgctgtgccggtacggaataaaccagcgttgcatcaccaatggcgtaaacgtcaggcaaattcgtgcgcaggtatggatcggtgttgatgaaaccgcgatcgtctagcgaaaccgtgcccttgagccattcagtagctggctgaataccagcagcttgaatcacaaggtccgtggcaatttcgccagcatcggttttcacggcgctgactgcaccatcgccggtgaacgcttcgatttttacgccgagttttaactcaacgcctttgtcagtcaactctttagctaagatgtcggtcatatccggatcaagataggtacccagcggccgatcaatcatatcaagcaaggtgacttctttacctgctttgcgactggcttcagcggcttcaatcccgatgtagccggcaccgatcaccgtgatatgcttgactgccggatctgcaagtttggctttgatactggttgcccaatcgtaaccgcgcatcaggaaaacatttttcaagtcgttgcctggtaccggtagtgagttcggccgcacgcctgaactcagaatcaatttgtcgtaaggataatcctgtgccgtgccgttcttcgtgtcgcggacagtaacggttttgacatcagcgttgatggccgttacttcatggttgttgaacacatgcgcaccacgtttaattaaatcatcagggcggaagttacgaacatcattcacatctgtgacctgatcttctaagaataattccatcccgcaggacataaacgaaacaaagtcacccgcttcaaacatggtaatttctgcatccggataccgatgcaataattccagaacgctttggtgaccgccgtgtgatgccccaacaacaatgatctttggcttgtccacaaaaatccctcctaggatatgtagtaaccgcagttatgtaacaacggctctatctctatattagaataattacaatctagcgtcaatagcagagaacaattaattattggacaattttattttagctttacctaaacccaatgatacaccttggcgtttgaaaattgccaatgtgtcggtctaatgggtaaaaaaaaccgctgcacagaacattgagggttctctgcaacggttttgcatgtaaaactagataattttaaaatgttttagcgccttaacaacgccatcgtcatcattgctggcggttacataatcagcatggttcttgacgacattctgaccgtttgccatggccacactcactccggcaaaatcaaacatatcaagatcattgtgttcatcgccaaaagcaatcacgttggctggctttagccccagatactgtgtgagttgcgccagcccccagcctttatcgaccccttgtggcataatttccagcataaacggcatgctgcgaatcacggtaaaccgattgccaaattcggcttcggcttgcggttgaatgttagccacctgctctggttcgccgagtaagataccttttgcaatgacaaaatcatccggcatttcctgaggttcgcgaaccttgataccggcgtgattttcccatgcctgcaaaactgtgtaccggctgatgtttcgatcggcggtgtagacgtcaccggctggggtcaaaacgttgctatcaatcccggccgccgataccgaggttgcaaaagtcgaaaaatctttataatcctgatggttcatgaatttttgcgcgatgattttcccactggtactctgaaccacaccgccaccttgaacgatgacatattgatcatcaccatgcagtcccagcgcgtccaacgttgtccgcacccctggcagtggccgcccggtacacggcacgactttgatcccggaagccagagccgtttgcaaaccctcgaccgtggccggtgacaattgcttatgcgaattcaataatgtgtcatccaaatcgactgcgatcaatcgaatcatggcagtcacaccccttcctgaaatcagcttagcacaggggcgttggtggcaacaatatgcaaccttgccgaccagcacaagtccggtgaaaagaatgctcgggcactaagccgtcacaaccgttaaatctcgccatggcggccgacatcaatcaagcggatcgcgtctggttcaactcggtaaatgagcagccaattacccttgatgaacaaagcacgatctggtttgcgttttttgatcacgtgatcgtcatacttttccggcagtggggtgctggtttgtaagtaagcaagaacttgctgaaagtcagccttagtgaagcggccggcttgtaggagttgtttgagatgttttttgaagcgggattgttcgataaggggcagggaggtgggcatggtagggacctttctaaaagtttgggttaagcatactgcaagaggggagcaggtgaagaataatagttgagcaattgtaagctcagcaacagagagtgtgactttccaattcactgtgttgaagttggatacgtacttagcgcaagcgctaatttacaagccgctttaacatataaccagcaaaggcttttaactcaactgcctgatattcactcacacgtccacttccagactggtattcgtttaacgccatcttgatgagtggacgccatttgggggataacgttgctagtgcccactccccaccggaagactttgatgtgacgagctgttcatttttaaacgccaatgcccggcataggtttaaaatcgtatacattggctgatcaataattgtagtgtctgcattgccaatgtcataaagaatacttcttaaatatgcttgggcaggaactggtgcgaaaacttcggagattggttctccggttaaaacttgaccacattgattgacgatcatcaaatgtgccgtgagatcggggtcggttccgtgcatttgattaatatactttgctggttcgcgcaaatactcttgatagtgcatttttgaaaaatgaaaatcaaagggaacgggttccgaaaaagtagataggtcttgtttaagaagaatgtgaaattccaatccttttgccggactcaaaggccaaagcttctcaagtgttacattcatgatactggccttagctttgttacttagcgggctattgacgacaacaagatagtctaagtcgcttactgccgggttgaaacagcccatgacataggatccgtgcaagtaaataccgactaaattggtggttaagatgcttgtataactggtttttaaaagtgtcagtaattgattggttttatccacgcttatttccccttcagtcggactcgctagctttttaggcactcaataacaagttcaaaataggcaagcttatgaaaaatacccatccgctagtttgacttacgggatgggcgctttcactcattgatgtgcagtcgtgtcctgagatgtttccggtaacttgatcgtttcaacgcgcacatgctgcggatttcctcgaagatactcactgatttgttcggcacttttttctatgtttgattttgacattgaaaaatcctcctgctttctgattcacaacgattgtatcttaaaagccgctgattttgttagcttttaatataagtaattgacgactttcaaatagtttagcgattgaagccaaaaagtagtgtgtgaaaaggcgggagagcaaagagttactggcttctcaaatgaaaaaaccatcgcgccacaatctgatacagcacgatggtttgaaactagcttcaacaaaagactctttcttgtatttaccctttttaaactttttcatcggcacaactcggccaactgtcagtttgttatcttttttggctttcacttcaggcgttgatgactcaggcgccaaacccttgattttttcatcgacggcttcagcaaaatttttgacttgttttgctgaccagagacctttattggcagttgaacgaataaacgctgccaaggcttgtaagaccggtttacgttgatttgctttgatgacttccttgtcgcttaggatgaaggtcagggttgttgaaagttcttccttggtccacgcttttatttcgtgattgaacatcaccttattactttgcatgattagcaaaactaacatggtgagcaggtcggggtcttcactttttccggaagacgatccaaagcggatgattcgatgaaacgcgaaagtaaatccaaaagcgtttgggtttgcggtgaagagaagtcaatggctttttcctcgaattccgggtcattttcgacgtcagctaatgctttttcaatttcggcatcatagccatcatcctcatcatctacagcttcgtcatcatcgtcaaagtaatggatcatcgtcatcgtcataatcagcatagtcggcgtactggctaatagcagcgtgggtagtggtttcggtgagtgcctggatgagtgccgtcatgaaatcatcgctggtgagctgaatctttttctgctgaatcagccacatgatcattgcgcgaataacgtctgcatcaaagtcaatgtcagcatatggatcatctgaattcgccgatgcctctaaagtttgttccaagccatcaacaatttggggaatatcgagtttggcaatgcttgagcgaagatttgcaaacgcggtggcgaaaaatgttatgagcgtcgaacgggcttgagaagttgccccccaacccacgtcgtctcttgaagcagcttaacaaaatttggagtggtgtgaaaatcgtcccaatacttatcaagttcacggcctgcgtggcgcaacattttcgtttcataagttaacttttctttagccattgccctgctcctttatttataagtgaggctaccattagctttagtttggcaggtgcaaggaggtgtgcctagtggagaacacgaggggatttggaggggattttgaaacccatgtggaacaggttgttgctgtgccagttatgtgcgaaaaaagatgattcataacaaatggtatatatggaatgataaagtaacaactgataaactaaaaccaacaatgctacgcgacggcggctctttttgaagaagggggtggtgcttatggtgtaaaaacgataagaccgcagaattctttagaaaggagcagaaatgtccgacttcgaagctttgagcctcatgatcatggccgcactattgttaatcgccgtgatcgagttggttctaaagctaatcgatcgtgactaacaaaaaagccgtcacgaaagcttgcaggcccgtgatggcttaatttagtcagaatgagccgccgtcaagcagcattgttgttacagagggtcgttggttagcagccagcgactcttttagtacacttttattttcagtgatccgtgcagagatgtcaacatatttgtttaggatttgaggcgggaaaaagaaaaattactagcctagattaataacaaatggtatatatggaatgataaagtaacaactgataaactaaaaccaacaatgctacgcgacggcggctctttttgaagaaggggatggtgcttatggtgtaaaaacgataagaccgcagaattctttagaaaggagcagaaatgtccgacttcgaagctttgagcctcatgatcatggccgcactattgttgattgccgtgatcgagttggttctaaagctaatcgatcgagactaacaaaaaagccgtcacgtcagcttaacgggctcgtgatggcttaattaagttagaatgagccgccgtcaagcagcattgttgtttcacgggtcgctggtgtttagccagcgactctttttagtacacttttattttcagtgatccgtgcagagatgtcaacacatttttctcggtgttaagaattgagaatacgatcgggctctttacatgttaacgttttaactgatagaacaatcacaaattggcaaacatcaagttgctatttagtggctggtgaattaggcaacattccggctacctgaaacgtgaatttgatagtgaattaagatggattcctgcttatattttacaaaaatcaaaattggtccattaaaaagccttaatagcatctttagattggctagattgatcgcaatatcaatcgtcactgcgatgctggctaccgttttagtccgcaccaatgaaaggcccaaagggcctttcatgaaggcaaaaccgcgttcaattttcccgcgccgcttctctgcgtcacgatcaatttgccgctgcttagcatccatctttttaggcttacgtcctaaacgtggtcccgacaacctaatgcctagtcgttgacagagctgacgattctcgcgggtacgataaagtgtgtcagctaagatttcatcgggataataaccatgcacgtcgaaataatgatcgatggttgttgctaaatcttggctttcattgaacgccttaaaatcaaatcgttcgatatcgatcatgccatcggcaattgaagcatcaattttgggaccaaattcggttcgttgtttggctttaccacggttaatcgggcgaatccacggttgtgccaagctaacaatccgtcctgggacccgatgggtccgattttcatacatgaacatttgctggtcaaaaagttcacgaatcacagccaatcgtttggtttgcctttcgttaagagaggcaccgtgggccaacagcacatcgatataacgtagatcacgtcggacatactggagctgtactttgatctgcttgcgtgtttccttagcccaacgccgcggttttctagcaaaagcggtccacttagcttttgcttcacgtttgtaggttcgtggaggcttgatttgcaactgatgagccatgtctaataacatttcttctagattgagccgagcttgatttagcagcgaagtatcttgtggaaaacgaatttcaattggcaccgcagtagcgtctgtgatcaagacacggagctcatcatctggcaataagctttgaatttgttcgcgcaaggtatcactgatgatatttcgcactagttccgttatttgacccatgcgtcgtctaaaataaaccaaggttgagtggttgaacggcaggtcggttgtgtaggtgtctagcccgataaagtactggtaagccggggtatcacgaatagcggtaacgaccgaacggtcggttagatgttctgcttgcttgatcaaactggcaccgtaaagcagacgaaagggtttagcagcgcgcccacccatctcagtaaaaagaagttgataggcttcatcgagctgttgccacgggagcatgtcggctaattgaacccactcattgtcggaagagagtggcacaccaaggccgttgttaaaggattgaaatgacaattgggtagcacgatgtcgataagccatgatggtttcctccaggaaaaataaaaagtgcaaggaaaacaggcgttagcccatgtttactttgcactaattataatctttactattctttgatgccaataaagcttgcagttatgctgctttcaccagccactatttatttgtgaagagggtatgatgcattcaataacgtgacctgtttaacgagaatagcgttaaagatgttattaaatcaacacttcgagaagaagattagccttagcgcaagcgttgcagagaacccggatggtgaaaaaggggcgttggcaaaaaggtgaagatgagcttcgaatagtgattcgtgcggttaacgcctgcggatcggttgcagccgttatcctgccaggtatcaacaggtactggaggcgatgtttcggcattgcaaacgagggtggtaacacggcatggccgtcccttgacgacatttttggtggtcaagggacggccttttttgaattcagcttgtgtcggttttggttgaaaagtgatgatgaggaggcattttcatgcgaagttgggaaaaattagtgctagtgggtgtggcgttgttggcgttggtcagcgtgatagcttgtggaaaaactaccagcagtacggcgacttcgagcaataagacgattgtaattggcagcagtggctcggattatcagatctggcaacatattgcgcaatcaccgcaagctaaaaaggctggtgtgaagctcaaagtcaaacaggtggcagacggcaatgtaacaaattcggcaaccgctgaagggcagttagatgtcaatgcgtttcaatcttacgcgtatttcgaacagtataacaaggcaaatccaagtcaaaagttggcggcacttggcactacctatttagagccgatgggattgtattccaaaaaatataagcgattaagtcagcttcctgatggtgcaacgattggcatttccaatgatccggcgaatgcaacgcgcggtttgttgctgctggctgcggccaagttgattacgttaaagccggattttaatgccttgagtaccgtcaaggatattcaaagtaatccgaaacatttaaagttcaaagaggtggatccttcagttcaggtattgcctgacctagatgcaggattgatatcaaatacgcgtgctttggatggtgggctaaatgttttaaaggattcgttggtgcatgagaagctgagtcaggatactcgtgccaatgtgaatattttggtgacggcggttaaaaataaaaacaagcccgaacttaaaaagttagtcacgctttatcacaactcaacgattcaggcctggatcaagaagactttttctggtactaaaattgaggtgaataagccgattagctatttacaaaagaaatagctttcagacagaggcggctttgctaggtataaatagacgtattttctggatctggcgctaaaagatagccgactcagcgtataataacagttgtatcgttatcgaaaaagcgagttgtccagtgaaaagatcggcggataattgcttagctgaataccgttcaccgtcattcacacatagactcacgctgacaataggaggttttatatatgtgctcatccatgacaattaaatcgcttcaaggggatattttctggggccgaacgatggactataacacgagtttcttccacgagtcgcctgctggtggggtgccggggaagattgtgagtttgccggcgaatcagacattgccagcgcaaacggctacttggaagactaaatatgccgcagttggcgttggggtcgatcaaagcgtggcgctgtttgatggcgtcaacagtgaaggtttggccggggacttgcaggtgctggtggaatgcagctgggcaagtgccgagtcactggcgaagcgcaatctgaagccgattaaaggtgaggagtttgtcacgttggcgctgacgacttgcaagaatgttgcggaagtgcgcgcacttgcgagtcagtatggactgctggacgagccgtttcagtttggtggtcaaggcgtcaagattcctttgcattacacgttcgttgatccatccggtgccggactcgtgattgaactgactggccatggtgccttcaagctgtatgacagtgtcggcgccatgacaaatagtccggaatacgggtggcatacaaccaatttacggaactatgtcagtcttaatgatcgcaactatccggaaggggccgatcttggcgaccaacatctggagccgattgaattaggaaccggctatggcatgtttggcctgccaggtgattatacatctccatcccgctttgttcgggcgatgttcgtgtcgcgcaacctcgacccgttcaatagcaacgaaggtatccgcgtgctttacaatgcgttcaaaaccgttttgattcctcaaggtctaggccgcgacccgaagcattcgattttaaccgattatacccagtactggtccggatacgacctgagtaagcgcgccatttttgttcaagacgccaacacgttaaccatgacgaccaagacactcgatccgaacctgactgaagtgacctatgatgatttggttaaaacggaacagtttaatcaactttaagtaagatttgcgggcatgaaaatacgaacggtgccctacgcttaagcgccatttcttaagcagcaggttcagcagattgaataagaaaaaagacgtctcaaccaagtacggattttgccatacctgattgtgacgcctctttttatgcggttaattaaaaacgctgctggttgacatgattactttttgtggcgacctttctgccagtctgccatgggaatgacgcgatctgatggacctgtcgccggtgttgccgcggctgtggcttttgggggtgtcgccggtatcttggcgagtgcttctttgacctgtgcttgggcggtatccgccaaagccttgagttgcgttgccgtccaaagatgcgagttggcagttgacttaatgaagattgccagcgatttacccagtgcctgctgcttatcacgcggaacgatcttcgtgtcacgcagcagtagcaacaaagcagcgccaatatcctggctggtccactctttaggttcgtgaccaaacatgttttgaatggtttgaatcaggaaaaagatgaccgcaccgaagaactcttcgtcttgagctgaatgcggtagttgatgccaggtcttagagtcgaaaaagagcatcaattgttcaatcagcgtagccatgctcgctgaatcgatcgtcatgtcgtcatcgtcgtcaaaacggtcgtcacgttggccggcacgtggcgaagcaagatcgccttcttcgaccagtcccaatacataagtcgtcgtgagtaaggcgcccatcaacgcatcgacaaaatcaatgatggtcaacttaacgcgtttggttcgaatcaaccaaatcatcatgctcttaatcagctcggcagcaatcgcaattgcttcactacgccggcgatgcttatcgttgatttgttgcagcgtggtttcgagtgcgattgaaaccgcctcggctgaaagggttttaatcgtcgagcgcagattttcaaatgactcggaaaaaaaagtgacgagaattgaacggatttcttggggcggaatttttgcgaaatccggatcctgcattaaggccgtgtagtcgctgcttttttgaaaatcaggccagtaaagatcgatttcgcgactggcgtgtcgttgcagttttacttgatagtccatgatatgccctccatatacggtcattgcgggttttattacccttagtttaacaggtgccaggtggtgctcacataaaaacttgctgtgggtgacgagagaaagtgcagaaaaaattgacgctgaattttcatgctagttagcgggggttgtggcagggaacgggggattttttagcatttaaaaacaggcatctaaagatacattacgcatctcatatgcctgttacacttttttggtcaataaactttttaaattgcaaatagcgcgtggttattcaaacattttcttggttgcgcgcattaaagtcttgatatctttgtcgtatcttggcgtgtgtacgaggtggctcatcgggatgccggtgaagtgataagccgcaatttcgcctgaacggaccgcgctttgttcggtgaagaccatctggaatggctgctcggcaaattcaccggtgaaagcgaggttggttgagtgggcgggaatgacttccggtcgatcaactttggcgcgattgttgaagagggccgaagcatacggcatgtaaaccggaatgttgttgatgatgcttgccatgatttcatcttggcgatcgcgaatgttgccaggacccggatcgactttagcaagctgaccgatcagttccaatgccatttccttccctgtcattttgatgtatggcttgttaacaaattcaccataacgacgtggatataggaagtagccccacaaaacggtttcgttaggtttttgggtggtgaagtgcggttggtgatgcaccacaatcgacatcatcacgtctttttgtccaagcgcggtgatgggctgggtggataagaaagagttcaacgcattgccagggatttgggtggtaatgcgctcgatttcgttgagcagcaagtgatccttggtggttaaggtgaagctgacccactcgctggctgcccgatccgcgaagaacttatccgggttgcctaggttgtagaagtggtccgtggcttgtttccataagctagccgcggcaccgtagtccatgttttcaacagcaggatggtcaaaatcaccttgagtggctgagtcggtgatggagccgttagtgaagaagacggcggtatcgtcatccacgaccacatgttccggcttatcggtttcggtgttcagcattttcaaaccggttaccgtgatttcatcggtcatcgcggtgtctttaaactcgaatgctgtgacgcggcggttgaggatgatgcggcagccttgatctttaaggtaattgatcagcggcaacatgatgctttcaaattgattataacgggtgcggttgacgccgaccagatgctcgatttgggtgaactcgtaaatcatcatatgcatgtaccgtcgcaattcctgcgctgaactttcaacgcggaaggcaaaagtggtttcccacatgtaccagaagttggtttggaacatatgcgggtcatctttgaagtagtcggcgatgctgacattgtcgagtttctcttcttccgaatccggcatcataatcagcttggttagcaaaaggcgatccttgttgtttaagccaaggtgaccggcttggataatgccgatgccgccttccattaaccgcgccttatcaaacgtccggtgctgagcgtcaaattgccgggtatcttcttccgccgtcaatccgggttcagttgccgatggaatgcgactcagcaagtccatcaaatcgacataggttcgataattgagcatccgcccaccgcgcgcgacgtagcctttggtgttttccattggatgatatttattccaatattcgtctgctgtctcttctgctggagcgccatcgttggacccgtgatcgtccagagaatagaacgtaatctgatcaccttgccaatgaccttcttgaattaaataaacagcggccgccatgttggctaaccccgcaccgatcatgatcgccttatgcttgatcattattttgcctcctagcgactttcaaacttcttgtatgcgtcagcgtcatctttaaacagttccattttgtttgcaaagtagcaagccgtgccacctgcaaccagcgccaatcccagcgccgtccacaagaattttttcatcataaaacgcttcctttcgctttctgacttcattatagccaggcgaaaaagaagcgtctttagtcaaaatgtgatgtttgttcgaaaattaacgttcttttccatgcgcctgtttgtgcacgatgaacgcaattgaaccattcagcatgagatccgctcgtttgatcaggtcacgctcgggttcttgcaaggattgggctagccacaatagaatctgacctacgatggcggcaccatagaaattgcaaatatcggccaccattttcgctggggtggtgggatcaatgtcgagcaccaccggcttcaccatgtcagtcgctgattgaaacaaaaactcttccagcatgtcacggcccacggaatgataggcattcaggcaaaaggcttggttggcaatgatgtaatcgagcaccagttgatacttggcctcccaagtcgccgcaccgagattctgcatgactttacggccaatatcggcttccagcgtccacttcaacaagccgtagatgtcttcaaaatggtaataaaaagtgttgcggttcacgtgtgtcgcggcacttaattcagcgatggtaatgcgatccaacggcttgtggtgcatgaggtctttcaaggtcgtcgcaaattgcattttggtttggtcagatgtggccatcacgtttcactcctgtggttaaaaaatatcagtttacgaatgcgaaaaaccgcttgtctgcaagggatgccgacaagcggaaatgaaagttacttgacctttagtggcttcaattgggcttcgattttatccaatgtcacgttagcttccagtaaagccgcagcggcgtaagcaccttccacaaaggccacgtcataaacgtgcatctgtttgtcgctgacctcttcggcaatatccaaattcattttggcactgccgaggtcgtaaaagacgagcaactcggaagccggattgtcgttgattgctttttgaatatgatccagatccgttccgatttgaccatcactggtaccgccagccgtggtgatcggaacatctttggccacttgtttgattaaagtctcaaggccgctggcgatggccggcacatgggagacgagcaacatgcccattgccatgaaaatcacactcctttggtttttgacggtaatttgctgaaacgcgttcgcaggggccagaaacctccacgtaaggaccttaaacctaaatggccaaaacccagccatttaggtttaaggccacttacgttccggtttctaaccggccctgctctcgctcttactgaaacgcgttcactggcgcagagatctgcgtgtaaggaccttggtcgcaatggcaaaacccagccatcacgcccaaggccacttacactccgatctctaaccgcgccagttcacgctcttgcctctaggtatgcctttagcagctctccagttgaggcagcgccgggatcgatgtggccgacacttttttcgccgaggtaagaagcacggccgcgtttggcagtcatgggtttggtagcttcgacgagtttgtcaatggcagcatcgtccagcttgccttgtttgattaagtcagcggcaggggcccagacatctagcatggtcttgtcgcctggtttggcttggccgcgtttggcaatgccttttgctgccgcttcaaccagatcgccgaagtcagtatcggttttggcgagtttggccatttccagaaaagcagtgccgtacaatggaccgctagcaccgccgactttactgagcatggccatggcgatggtcttgaagtcttgggcaagatcagcagttggcggcgttttttcgaatgcagccttgatggcattcacgccacgctccatattgttaccgtggtcggaatcgccaatgacccgatcaagttcggtgagatggtctttttgctgcgtaatgcgattttcgaaatttgtcatccatttagtcaaaatttcagcggttaacatcagtatccccccagccaacagtgtgtgcagatgcattcagatagttcaaccattgcggatcgtctagtgccagcatcgtcagtgaaacccctgccatgtcaagtgatgtgacatagttgccagccttggtgaagtcagctttaaggccttgtgcgtgtaactcgttcaaaacatcacccatgaaaatgtattgttccgacagcggggttgcacccatgccgttgactaaaacggcataggcatgcgctttaggatctttaaactcaacggttaacttaccgatcaattgtttggcaagtgctttggaagtcggcaacttttcctgaccagtgccaggttcattgtgaatcccaacgccaaattcgatttcatcaggcttgaggtcaaaaccgggtttgcccacttcaggaaccgtcgcggcgtgcagtgcaacggcaaacgacttggtatttttaaccacagcatcgcctaactttttgagctcatctaggctgagaccggcctcggcagccgcgccgattatcttttcgacaaaaatagtgccggcaacgccacggcgaccttgtgtatacagcgaatctttgactgccacatcatcgtcgaccaccacggattcaacgtcaatatcgtcgacactggcgagatccttggccatgtcgaagttcataacatcgccggagtagttcttgacgatcatcagaaccccttcgccttggtcaaccgccttaatcgcggcataaatctgatccggggtgggtgaggtgaagacctgaccggcaacggctgcatccaacatgccttgaccgacatagccggcgtgcagcggttcgtgacctgagccgccaccggagataaccccgactttcttcttctgcttgaacgcggcgtcattgcggacgaccgccgttgtttcaggaatctgtttcaaatattgcggataactggcaacaagaccagcaatcatttccgggacaatatcgcctggagcattgataatcttcttcatatttgcaactcccttctagttatcagtgtaacgcttgcagtgctaaaaatcaggtgggatgcaaataataacagaaggtatttgatcgtatggctgtaggctggcaaccagttttttcatgatgatcgcaaggtgtcaaaaatcgcctcgttaagtgtgaatccactcaacaaggcgattttcgggcaagcaattaatcggcgaaatcagtaacggtttcgatggtgtaattgccgctatttttaagtaattttgaaaccgggcagcgattttcaatttcgttggtaaacgtcttggccgtgtcaagatcaacacctttgaccataacctgagcgtgaaccaagaattgatactccgcgcgttcaccaatgaaggcaactttaactcggaccgcgcctgtatgcggcaagccgtgttccttttcaacggcttctaaggttgcttccagacaggtgcttaacgacaagcccaaaagttgttcagggttggtgccgggatgatcgttcaatggactgcttgtttgaactttaaggccgccgggaatatacgcgtgcccctcgagtccttcatcgttaattgcttcggttgtatacagtggatgttgccaacgttcatctgccattagttttgcctcctaaaaatgagagtgcgccaaccggatttctgggatggcacgcgttatggggtgcatatgctgttgcaacaactactgcttcaacagtaaattgcgtggtgaattgcacagcacatgttttaaagattcaacacattaacaattataagcgcttacaaggaatttgcaatttctgggggagaatgaacccaaacgagtattcgtatgatataacttttaaattgcttctaagcgttaaatgaccctttcgaaactagaccccagatgaaggatacgatgctatgactttttgcaagacaacaagtatttcgtttgaaattggtgtacgaacagagtatgcagcgtagaagaattctggacttgattttggctaataagttcctggctacagaactttggaattgaaattattttttgagtttcagttattgcagtaataaccctgactattgcaataactgagcatattgatcttttagatgacgataatccttaaacttttctatttcaagatgttggtggttgatgaatatgccaacatcagtaacccgtgcaagttccgctaaattgtgcgacgagacaatgacaagttttcctcttttacctaaatcaaatatagctttctgaacaatatcaagactagttggatcaagcccatttagcggttcatctaataaaataattggagtatcgactaataatacaagtgtaatttgaagtcgttgcttcatgcccatcgagtatgttcggatttttttatcaatgaatttagaaactcccaactttgccatcattgcttcaacgttactttgatctaaatcatgtactttagcgactaagtcaacgtaatcccgccccttcatcatgccgctaaatgaagaagcgtcatcaaaataggcaactgttttaaagacgttgcttcttgagttcttttcattattaatcaagatattaccgctggattgtttgactagtccgacaatcaaacggagaagagtagtttttccggttccattaggtgctaccagaccatagactcctgaatcatcaatgtgcatatttgcttgatcgaagacgcgcttatgtttgtattgaaaggttaagttctttatttctatcatactggtcatttagtattacctcctttgaagtttaataactagaagacctgaaaacaaaaacattataccaagacttagggtgatcaaaataacggatagcaaagaacctccattttgaaaaataaatccatcagagatcatagaaatatgcagagaagcaaaaggagaccaccatctgattggtagtagtgaggcaagaacgacaattatactgctaacaagtgtttggacaagcgcattacttatcagtgtttgcaaaaggctacttattgaaaagaaaaggaaaatattaatcattaataaagaaatatcggtcaaaactatttgccacaactgcataaaatttccgttccaatcaaatatcggatattctaagctacctagactcgcgaaggctgccgatataagaaggaaaaccgctgtgattaccaatgtcatgacaaaatatgacaatatattcagcaaaaagccgcctaaatatgccttttcctggctaatattaagcatttctaaccagtcatttccacagcctgaggattttttaaatccgatttgagcccaccagcctaagatcactaagccaaagatggtgctgaggacattaaaaactagttcgtggaagagatgttccaaaaagtaaaatccatgagtgtaaaatcttgtcgaaaattgcatcgaatactttttaaaagttaagtcatctcctccaaaagtcaactttgtgctttcattagtcagtaaacgtgctgggaaaaagggcgttaatttgttagacgctacaaggttaagttcattaattgtgttttgatattcgccagatgtatacatgtttgttatatcaatagagataggtgtaaaagcgtttttaattctggttccgagcgaggaagtcccgttattatttcttcttatggaaagtgcctctaagtattttcggttatattcatctggcccagacttgagcgcctgatattcgtactttatttgtgccctcaatgatgaatccctttttaccgccggagcctttagcttctcttcaatttgtgatcggtaagagttaacgtacttctcttgattctgtatttctatgaaaaataatgtaaataagatagctaaagtaatgaaaagaggccataaaaagggaaatgcgttttttaacaccttatgctgccatttaattaaaatcatttgacttccccctttggccgcttatcaatatactgattgatgctataattaataaaatggtaaacaatgtcaggactaacattgagctgacatctggtgtcacatgatcttgtataatataaaagggatttgtatttacttgtatttcggtgaagttccatgtcataaaaaaaccgaatccggtgcatatagcgaatgttactagagacaatattgggtttttaagcaggctcaacaataatctgtagatactttgtgtcaaccagcaaagcactatgagaatccaagtctccaaacaggtttctttgaatatcgagttccgaaaagagggccaataaacattccagtttagtgaagatgaggttgggaaaaggcctttactaaatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaaatagttttaaataaagtatagataaactgacaactaatatggcaattattatcggcaataaaagcgaggatgcaaacgaaatgagtggcagagaaatctgctttttatcattaagaatcatgaacgctctcgaacttccaaattcaactatgacgatttgaaggagagtaaggacatttattagtactaaaaaaggaaaagtctcgaaatttttcagaaaagaaactgctcctaagggatacaacaagctaaatttttcatcttcatatgggagaccctgttttatcagcgttgccactttataataattatttttaagtgctttttgtgactctcccaaaggccagaaactatatttctttagatatttacttccggactcgaagatgactttagtcttttgtaaatattcgtcggcatcgaatgattgcagactctgtttttgtaactgaagttcatctatcagttcaccaagatcatcaaaatgtcttctattttctggtagaacattcccttgtgagtcgagtagagtagtttgcgtttctttgattactgtaatattatgtgatattacattattttcacgcaaaaagaaggttgattgtgcgtccgaaaagctgaaaactgagattaaaaaaagtagtataggtacaatgatacataatacccagatacggcttgctaatgctgcctttacaaagaactttagcataatttataccactttccgataagacatgaaaggacacattctgttgaatgtgtccggggaatattaccagctatagatttgacccctataagctgcaacgtatccaccatcaacttgatgataaccagtgcggtttgccccatacgtcatgtaggggatatcgccaatgtgcaaatcacccacataaacaactggcggaaattcagtaaatgccattgaaaatgttacccatgtgccatcaggataaactttactttgaattgaagcaggactcgtaacatcttcatcccctcctcgtgtaaccaatgatatccgtgatggctagcatttttttcagaattgcagatttgaatcggaattttacaataagaaaattcgtctacaatggttctttttgcggtattaactggcgagtagtcaagttcttaaaacgatgatgggttgacttcagaggctctttttcccgcagcaaaggtattgtcaagtcgtggcataacatatcaaagacgacttctcacagggaagccgtcttcaatgattatagttttttcaacactattgatgaacagataaggaccttaagcattctttagattggtagtttacctgcaagtttgtccaatttcattagtttcaacactgaccttatttcgttgatctcagcgttcttagatgcttctttagatttggaagttaaggcctcatagtatttgcccaatagtctatagaaaaagaagactggggtgagcggcaaatgatttagataacttaagggcctattcatcattgaaatttcgttttttctgtaacaagtgtcaatgtagtttataaatatagttgataatgtgcttagcaactcgtcattaagcaaattttgcctattgtatttatgaagaagagcgttgattagaaaactaagctcatcgaattcatatagatcgattgtattggcgaataaagcaagcgttcttgcgttccaattatcttgactaaatagtatatcgcgactactcgttttagttgtctcatccagatctttgagactatctgttaaaatggcttgaataatttttcccagaatctcagtgttgtgctgcctatcttgcaccattggattctgcgataagccatcattaatcttttgaactgtcttaagatcatttgaaaaaaaggccgaatacagcctctgttcgattgatgccattgactcagattttttttgttggatcgatacttgtgacataaatttaggaacggatattttatttagttctaggatactaattagatctttagcattaatatcgttaatgtcattttctactttagagtaaaaagaggttgaaatgacacctgctgccatctgtttttgcgttagtcgcaatttgaggcgctcggcttttaataaagatccaatggtttgcattttaacaactccctcgtatatgtgaggcttaattagtgcctggtgatttaggctgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaacccgatgaagtactgataggctggtgtatcacggatatcgtcgacaacttggcggtcggtcaggcctttcttcaacttgatcaacgttgcgccataaagcaatcgaaatggcttcgctgctcggccggtttttgaaggaaactgtaattggtatgcctcttcaagtttggcccatgggatcaattctgcatattgaacccactcgttgtccgggctgagcggtgttcccagagcgcttccaaaggattcaaatgacagttgcgttgctttttgacgataaaccatgatcaattcctccgataggtcagcgataagtgcaagggtaaatcccaaagcataggcatttcgggcaaataagggttgcacttattatacgccgaactattggtaaatcctattattaaagtacttttatagtttttcaccatccactaattagcaaagtcaaatgtcggaatgaaattggcttcagacaatgcggatctgatttagtcactgtgattaactctttaaacccagatttttgcgcagtgaattgcggtaagtggaagagcatgcggtttaacttaccattattgacttgagcgttatttattataaatgctcataaaactacgtgagcgatttatacactgagctatccccttagcgcgtcagaaatcaatttataagcaatgacgatcaaaatgcaaaaactaccaaggccgaagattaccgatatcgcaaggatcgcaccactgccaattttcgcataaagtaggccgagaaataaagctgccaagaatgttacaaattctataatccatagttttagcaaatgtatccaacctccagtgttactttgtaaacaagctgttctatgctatacggcatgaacagttgaaattgatcatggtgctaattttaaactagatcaccggtaatatgaatgacttctgaaacttgagttatttctgacgcgctcagacatgatcaaaagcggctacgtaaggcatttttctgcaattacaaaaatgtcttacgtagccgagtagttcacgatttcggatcagacttttgatccggttctgggtcattagcgcgttctggtgggcgttgagaaaaaccgatatcacgagtgatgagcgggtggccttgccagatgaggtgttccagcagcgccatggtggttttggcatcactgagcgcggtgtgggagggcaggtcgattccgagtgcttctttgtaatgttgcagtgacggggtgtgttttttgccgataccgaatgttttgcgcgccaacaccgcagcatcaaacgcttgaatggggtcaactttgatggctaggccggattgcagggcacgaagatcgttgcttaaggcgaacccgacaactaattcatgccgcagcagctgttgcagtgcagttttaacaagtggcagagattggccgtattttgccaataagtcgtcggtgatgccggtgattttaaccgagaatggcatgacgtgatggccggctggcagttgcgtgaaaatatcgaatgtctgatcaatccgatgttggcggacgcgcaataagctgatttcggttaagtcaagctgattgcgatcggcgacgaattcggtgtcgatgacgacatagtcaccgtgagcaaggcggtctatgacatcgcgctgggttgtcaacgctggctgatctgaggcaagctcggttactaaagtggggttaagttgtaatgatttagctgcacgacgctgggctgcttgaactaggggcatctcttcgcgggcgaattttgcagcaagccgcgccatcagttgatctgcttgaacttgccgctgatgttgtagtgagaccagcgattgatccgccgtgccaagggtaatatcaaatagccgcgcgagccagattgctgcatcagaagccggagcggtagtgacatacaccccgtttatatcggacagtgcgaatgccacttgcccgttttccgcccagttggttaaccccaaggcgagtagatgaacccaatcgcgaaaaggccgcatgaaggcaaacaactggcgctggcggtctaaccgatctagacgcttagccgcggcggacacagctgcggccaattgcaaggcgaggcttttgcgatgattgccaaagtctttgagcttaaacttgactggtaaaatggcactgcgcgggcgcaacatataacggagacggccaccttccgggaaccagcgggctagatcaaagctgacatcgccacgaggagagacctgattaacggtggccggctgtttagcagttggggtacgatgctggagaaccgccatcagttcgttgagtcgggtgcgaacctcggcggcgttgcgcggcttggtaatcggatcacgcagtaaatgattcagctgccggcgagcttgacgtggtgagtgatttgacttgcgatgtggtctggactgcgccatgatgacagcctcctttcttagcgaaattaaagctaagaacagtataccaagtgtggcggggatttacatttttggctcttgagtgatggttgagcagacacaatgaaagtacagattggttttgcgtatgttaaaacaaaaacagccatcttcgaactgaaagtgagtcgcggatggctgtttggattgtctcgtaaagtttaaatgtttgacgagtttgatcttactcaatgttcaatgtatcgcggtgtgtgcctgttgcaagaaacattaaaattaacgcttcagcatcgactttataaacgagaagccaatcaggagcaacatgcaatgctcgttcgccgctgtgagcaccctttaaagcatggtcgtgtaaagaagctaattttacacgatcttgacgctacaaagttgttgcctgtcaatatgcatgcagttaaccgtcaacatcactgtataaatccttcatcaaagcaccaacagtcttgaagctttttattcgccccgctttaacatctgcttctgcaaatcgaagctgatcggcgaatgacatttcaagtgtaaatggcaatgcaccggtgtcaccaatccgtttccaatacatgttaatagccgagaatctctctagtcccagacgattaagaacatggagagctcgttttctggttattgtgttaatccaattgcggatacgggattcttttgccatgatgattatctcctccgggttatattacatgaattgtcgccaatgagctaacatttttatctgactaaaaatctcccttgtattgaacccaaaattatgcgataactgttgtatggatatcaaacaatcagtcattaccgagaattttaaacaacggttgttctttgcgctgtctgatcccggtcgatataaaattgtccgcatgctttaccacgtgggccacgagatgggctgcaacgagttgaacgaacacgtggagattgacaaatcaacgatgtcatatcatttgcgaacacttcgagaaatcggcatgatcaccacgcgaacgcagggacggcaaaagtttgtcacgttgaatcgagaaaaaattgaagcagcgtttccgggattactggaaaggctttaaaaataagcaaatcaatgcttattttttagcggtaattgtttgatatttttaaaactataaaatgaactgggggctttttgcatgaaacatcgtcaactatctttacttttcttcttagtcatgtttgtgatcgggacggacactttcttagtttcaccgctgttaccgacactgacacgttattatggcattacgaccagcctttccgggtttattgtcagcgcctatgccattggatatatgctgtcagcactgttgatcggcccgatttcggatcgccatgatcgtaaaaagatcctggttggtggattagtcgtcttcaccgtggcgactgcgagttgtggattggcgaatacctttgcgtggatgttgatcacgcgctttgttgccggaattgccgctgcgactgccgggccacagatttgggctgcgatccctgttttattcccgcgtcagcaagtggttaaagtgatgggctatgcgaccgctggcttggcagtggcgcaaatcgttggcgtccctttaggcagttacttagcagtttggtcttggcggttcccgttctttttcgtcggagccattgcgttgatcctgacgcttttggttatgcgcctaatgcctagtttgaatgacgcaaaagccgcaccggcatccgagagtatttatcggcagctcatcggcaatcacccggttatgaagttgttagcggcgtacttattgttccaaacggccaatttctgcggctttgcgtttatcggtacgtggtttgctaaaagtttcaacttatccgttggcgcgattggcagctttattctgttaatcggcgttggtcagtttgtaggcagccttcttggcagtcggcttgtgacatggttaggtcaacctcacgcctttttacttgaatttatcttgtttatcatcggttatgtggtgctaccgtttgccaactcaccacttgcggccacgattattctggcgctcatttatactattggcggggctttgttgccgctgtttatgagcacgttacaggagcatgccggtacagctcgcagcacgatctcagcgttggccaatgcggtgatgtatttaggcgaagcaattggcggcgtcatcggtggcgttttaatcaagcagtttgccggtttttccggaatcgcaacgtttacggcagtggtcgcggtgttggcaatgctgttatatgcacagcagggatattttaagcagttacagacaagcagataacttaacttgcattggaaaataattcgtcaagcccggtttcgacatcattgttttacaaatcacgcgttgacaagttggcgttgttttaacctgacagagattgtataattacaaggtagaacatacgtttgtgtcttgagaggggaatgtcaattgccagctaataaacaaagatgcgcgtgggcggataccaccaatgatttaatgcgtcaatatcacgataccgaatggggacgcccgagccatgacaatcgtcacttgtttgagctgttgtcacttgaaattatgcaagcaggattgagctggcagaccgtattaaacaagcgggcagcatttaaggcggcgtttgctgatttcgattatcaacaagtcgcacaaatgacgccgcaaattcctatgcttttgaaaaatgatcaaattattcggaatcgaatgaaagtgacggcgatgatcaaaaatgccaatgccgttgagcagttagtggccaatggtacggattttgaccattatgtttggaattttgtcagtaaccaactcattcaacatcatattgagcggcatgaacaggtaccgaatacaaccgatttggccaaacggatgagtaagcagatgaagaaggatggctttgcgtttaccggtccggtggttgtgtattcgttcatgcaagcggcggggttggttaatgatcacgaaataggttgctttgtttatcagcagcttggccaataaccgggcattcagattttggattgacggaaccatgatttcacagccttcaaacggggagcgtatttgattaaaatacaataacccatttatactggtctaaaaccaaaaagaggtctgatcaatggaaacgacaatttgtaagattggagattcggttggcgtcatttttccacgagcattacaagctgaagttggcaaaaaatataagatttctaaagttaaggatacatttgtgctgacaccgctgcgatctgatttatttgccgctgccgctgattggcaaggattcagagatgctgtgactgatgaagaccgagcatgggatgagatagaggactaagcttacgtcatcctaaattcagtcacagcggcagcacttatccttaacagctcaagtaacgagagacgaaaagaacccactcgcaattttcagcgagtgggttctttaaatagtctttgattaaaaaattaaagtgcttcaggaaccatcttaactggcttgttgccaatccagccggtgatttccttgaaggtatcggtgatcgcatcggtgcctggcttgagcatcttacgagggtcaaagcccttgccttgttgatccttaccagcttcgatgtattcacgtgttgccttagcaaaggcaagttggcattcggtgttgatgttcaacttggaaatgcccatggtgatcgccttttgaacttgttcttgagggataccggaaccaccgtggagaacgagcggcatcttaacggcatcgttcaattcttgtaagcggtcgaagtgcagacctttccagttgtctggatattggccgtggatgttaccaatgccggctgccaggaagtcgatcccggtagctgccaaggtcttggcttcttcaacgtcagctaattcaccttcgccgacaacaccgtcttcttcaccgccgatggaaccaacttcagcttcaacggaaatgcccttggcgtgggccagcttaacgatttccttggtcttttccaagttatcttcaaagtcgaggtcgtggccgtcaaacataactgagttgtagccagcagcaatagcttccttggctgcttcatagttaccgtggtccaagtgaatcacaacaggaactgtgatgtccatggctttaacggcagcttcgatcatggtttggcaaaattcatagccacccatgtacttagcagcacccatggaagtctggatgataaccggaacgttcaattcttgagcgccggcgagaatggcacgagtccattccaagttgttggtgttgaaggcaccgatacagtagtgacctttatgtgcagcttttacaagctctgcagcgttaactaatggcatgtagatatcctcctacgaaatatacaattcacaactgttgtattctaccataaatgacaaaagaaaaggtcgagaaaatgatgagaacatgacggttttactgaccggtttgaaaggaaacggtcacgctgataacccatcgttaccgaagcccaattaaatttaccgtagtttcggaaaaaacgccattgattgactcggtattttcagaggttagaatctgcttactcaagccaactagccaacaatgaaaaagttcatgacaatgacggtgattagcgattgttacaggctaaaatgagatttttctcattttatattagatgaattgcggggtaacgtagtggatttcacaagctgatttaaaatgaccgacgcataaatcgctttctttagggggttgtgatgacaggatcgtcaaaaaataactgaataaaatagcttttcacaagcttgtagtgtccccacaaataagaccttgcttagaacgattgaccctggaaatcaaagcactaaggtaaaggtagtaacagattgataacaattgagttgttcacacgaataaattaaccaaaggagatcttgatatggcaacaaaagcagcggatcagttagtcagcgtcttgatggattggcaggttaagcatgtgtttggcttacctggtgactccattgacaccaccgtggatgctttacggcgccaacaagataagatcaagttcgttcaggtacgccacgaagaagtcgccgcactggctgctgcatcaacggctaagctgacaggtggcctcgggggttgcttgtcaatcggcggacccggcgcgattcatctattgaatggcctgtatgatgccaaaatggatcatgtccctgtactggcgttattagggcaagtcacaaccagtaacttaaatgaaggctttttccaggaagtcaacacgcctaagctattcgatgacgtggcggtttacaacaaaaccgtcatggcgtcggataatttaggccagatcgttgacacggctattcgcaccgcgttcacggaaaaaggcgttgcggtgttgacgattcccgacgacttgcctgatcaaaaggaaaccaccagttatcgcgacagtgcagcggcgtttgctttgaatgtaccggaagtggatcctaagcagttggatgatgtggcttcgcttttgcaaaagtcccagaaacctttagccttgattggtcgcggggcggaaaaagccggtgaagccgttcaaaaatttgtcgaaacgaatcacatcccgtttattcagaccatgccggcgaaaggaacggtggcagacgatcatccgaatagcctcggtaatgtcggcaagctcgggacgaagcctgcgtatgaagccatgaaggcaacagatctgctgttcatgatcgggaccaattatccatacaccccttatttaccagatacagggcaggctaagtgtgtccagattgatacgcagccggagaacttaggcaagcggtattcggttgatgttgccgtggacggcgatgtcggtgcctttttaaccgaactgaatgctaagggagctttgcgtgatgatgatcgcttcttgaaggcatgccggaagaatatggaaagttgggacaaatggatggccgaaaaacggttactggatacgaaccctgcctcaccggaagccgtctttgcgacaattgaccaaacggcacctaaagatgcggtttactcgattgatgtcggcacgtcaacgtcttggggtgcccgttttctcaatgtccagccaacgcagaagtatacgatttctgcgtggttagggacgatgggctgcgggttgcctggtgcgattgcgggtgccgaggcatttccaaagcggcaaaatatcagcgtggccggtgacggtgcttttgccatggtcatgcaggattttgtcacggcggtcaagtataagctgccaatcatcatggtggttttgaataatcaaaagcttgccttcattgaatacgaacaacaaagcgccggtcagttgaattatgaaattgatttggccgacatggattacgccaaaattgccgaggccgctggtggcgttggctataccgcacacagtaatgctgaatttaaagaggcactcaccaaagcctatcaagaaacagacaagccggttttgatcaatacctatgttcaagacgacgcgccactaccaggaaaaattgttggtgaagaagcgaaaggctacatgaagtatggctcccagtatcttgaaaattattggaagattccttccatgccgccattgaaagatattatgcggcaattcttctaaaatttatgggagtgcaacaatgaaaacaggcacggcttaagtttgaaagtgacttaagccgtgcctgtttttgtttggagtggttgacgagcaaataacgggaatccggcagctgaacttggtctgcggattatgctagctcgtgcatgggttattacatgctaacggtattaacacgccgcagcctttaacatcacaattgtgggtcaaaaattacaagctcagcggccaaagattgttgccaagctgtttaaacgagaagactttatcccagagtgctttttcttcaacagtaaacgaaaagcgatcactcaacttaacggaaggcgcagaattgaaaaaagattggagcgcgccggtgaaggcagttccgtggctgtttttcagctcttttaaacttttggcaacgtatctcgccgtctcggaactcggatggttgtggctcagctttacgctcagttgttccatactggcgatgacttcttcgggttgaactttcatgaggcgatcctcctgcttttcaatagaatacgcttacattataattctaaggcaagttggatgcaatgcattttacttctaaaacagatgggaatgccgatgtttattgatttattttactctttatgctaaatattacacttttaattaataaataaactaatatcagcttgctatcttggcgtaaattattgcctttaaactataacgatgtgcgccagttggccatctcctcttgtcattttttgagtgtctcaacgccgggcgacatgttggtcagcgtaatctgtgctaattgcttttcaaatgaaacatcaaaaaacgcccagtaaccgaaaatatgaccattgtgacttaaccagtgctgtgttcgggatttcatccaacccatgccgtaaaagtcgtgggtcagcgtcagtgcctcatcccacgcggattccggcaaaatgcggcgctgtaaaacggctcgcgcccagatggccaagtctgcgagtgaactcaccaccgcgccatctccaccttggtagtggccgcggccaagggcgactggtttgccatcagtaaagtccaaatcatcgtaactattggcatcagcatgttgcgtacccagccgagttttcgtcattgccagcggcttaaagaagtgttagttgagaaaatcgctcagcggcttgttcgcaacctgcgtaataatgtgtcctaggagatagtagttactattggaataggcacctttttcatctggcgcaaagtcgaggggatgttgattgagcaattcgataatctgctgaagggcgtcactgccgttgagatcttctaggatgggataacttaagtgcgattcgctcgcatcgggcatttttttggcatagtcggccagcagtagctccgtataatccggaatcccactcgccatatgtagcatctgacgcaaggtgatttgtttggcgaaacgatattcaggcaagtagtccgacagcggtgcatcgatattcagttttcccgcggcatttagtaataagatactgttggccgtgaactgtttgctcagtgagcctaagccgctggtggtgttgagcgtaaacggctgacgcttggcaaaatcagccatgccgttttgccagtaagacagcatacggtgagtgtcgaccaaaatagcggcgccgtttagttgatactttttattaattagttgataaccttgaagattatgcatgcagattcctcctcgtctggatacttgaacgtataaagaaacaagatcttcctagctcatgaagatactttctactctaggttaaccgccctctttggacaaggttaagaaatgagaaagtatagtttacatctatgtctgatcgccgttacgacttgccatatgaccctataccaaaatttgctacatagctagaaatatctgctgatctctgatgcttacaccccaacaaatttaacaaagtcccattattttgaagtttttacaggaaacgaacataataagccaatgaaaatgtgagcaaagactcaggaggtagacgactgttcaagagcatccattataatcgcataagtaatataatatatggtaaaaagcattgacaaaaaatggaagcgcatttatacttgcgaaaaccaaatagaagaggggataactattgaaattggaagcaaaagtcttctgcaaatatcatcggaatgctaattggcgcacacaaaaagtttgtgcgattgctggttagtgctatgcccaatgagtggaaaggtgattggaaggattatttggccacaggaatatcattgttaatagcgggcacaattgtgattttcttgattttgccatttcaattttttcaacaacatttgttaattaccggtattctttttgccataatatacgttataatttttttcttggtatctttactattaaagaaagaggaacgtattaggctcagcagtttttttaaaaaatctaaactgtaattaacaacgtaaccatatgacaaagacgtacttacattttccgattttggtgatgcaagcacgtcttttattttttgctaatgtgcaaagaaactagaaacaattttgaagataagacattgccttctataaatgaacttcaacgcccaatcccggccgatcagacaaggttaaggtttctccgtctgcttcaaatccgccagtgagccaatcggtttcttctagcaacatgaagctatcaacatcgccgtaacggacattggcgtgggctgcaataaaatgggcggaggcagcggttcctaggcgggtttcggcgttgcagccaaccatgcacccaatcccggccgctgcggcgatggcattgatagcgttggcgcctgcaaaaccgcctgacttggctaatttaatattgatcaggtcagctgccccgagtttaaccgccgcactggcatcatgtgcgttgtgaacactttcatcaagcatcaacggcaccgcgagttcttggcgaagtgctggggcttccatgagttgccaatccggtaatggttgttcgagggcgatgaggttgggaagttgcaactgcgccatgatgcgacgggtttgagcggcggcccaggcttgattggcatcaactttgatggaaacgttagggccgactgctgcgctgaccgctttgatggccgcaatatcggcaagttcatcgttaccggcctttaactttaaggcggtgaatccagcgtgtacatattgttgggctgttgctgccatttcttcagctgagccgatgggaatcgtgatatcggtggtaatagtgttgcggtcgccgccgaacaattgccaaagcggcatgccagctgactttcctaaaatatcgctgcaggcaacgtcaatcccgcattttaaggcagtgtgaccggccatcaccgcatccatccgcgcatggacttgttcgagattgcgcggatcagcacccacaagtgttgcggcaaatgttggtagagcagcttgttcggtttcattcgtttcgccgttgaccggtgcatacggtgatgcctcgccaaagccggtcatgccagtatccgtttcaattttaatgatgagggtcgtgatcgcactcaattctcctaaggcaagtttgaacggggttttgagtttaatcggccggggatgagcggtaatcgcagtaatttgcatggctgcctcctattgataagtgttgagccaacggtagcatgcatcgtcatgattttcaaactaaaatatcattggaatgtaacccgaatcaaatttttgatggacagttttctagccgtgcggttgcgtcaccgcgacaggactgcgatgatggcaataagcagacaacgatggaggcaaaacatgacagctatttatgatgatcccgattttttcaaggcttatagtcaaatggatcgctcgaaaaagggcttagccggcgctggcgagtggcacgagttgaaaacggtgctgccggactttaccggtaaacgggtacttgatctggggtgtggctatggatggcactgtcgatacgccgctgaacatggggccaaaacggtgctaggaattgatacttccgccaaaatgctggccgaagccgcgacgatgacccacgatcaacacatcgtttatcaacaaatggatatgcaggacattgatcaattaccaggatcttttgatgtcatcttaagttcactggccattcattacattgctgattatgccgggctggttcaaaaaatcagcgccaaattacctctgggcggccagtttatcatgtcggtggaacatccggtttttacagctcaaggtgacgagacatggatcaaagatgatcgcgggcacaacctttattggccggtagatcgatattttgcggaaggtcagcgtgaaaccgagtttttagatcaccgtattcaaaaatatcaccggacgttgacaacttatttgaatacgctgcttgatcatcacttacgcttggatcgtgtgattgaaccgacgcccactgccgcgatggtgcgcgatattcccggtatggctgacgagctgcggcgaccgatgatgttaattgtggctacgactaaggtgaggtgaagagcggcgttttacctagcccataaaatgatgcaggtagtagtgagtcacacgttctgatatattagttttaacaacgagctaatctcactggaggtattttgatgagcaaaacaacgcgatgcacctatctgcttttgggcgcagtcttacacgtttggatactgaataaattattgaacccctttttgggccaacagtatcaagcgacatactccctgctgttctgcgtattgtttgttatctctgcgctattgttgggtagtctgttggccagtggcgacaagctgctgagccgcgctggttgttcatttgttcttgaagtgttaaccactggaagcattgagcttatgtactggaagaattttttggagatcatgctctacgcggtacctatcctgctgattcaggggttggttttactctttgcggccctattacgggaaaaacacgccaaagtgatgcattaaaagcccaacgaaacgatgataaagcgatgcctaaggattgttgtgggtgaaacgacggcgtatactctgggatattcttatttaaaaatgtgcgcgatttggccagtgttttggtaccggcagtcgcgtttaaggagtgtacgcatgaaacctagaattggtattcccaccgatgaactcattgaaattaatcctatcatgccgaacaatcatccggcttatgcaccacatgatgtcaaagaggctttcatcaaactaggcgcgataccgttgatcatcgcttttccggatgatgtcagcaaggttgaccagctggcacaagattatgtgcagctgattgacggcctgatgttgccaggtggaccggatgtggacccaacattttacggggaagagccacatccgaagatcgggatgacgctgtaccaaaaagatcgttttgaaattgccttgattaaggcggcgttggctgcggacaagccgattttcggcatttgccgtgggattcagattatgaacgtggcgatgggcgggacgctgtatcaggatcttgagagtcagtatccggaattgaaaatccaacacccacaagccacactggggcaatttgcgacccaccatgttgaattgaccgctggcagcaagttggccaagctttacggacggtcaacgattaaagttaactcgcgccaccaccaagctgttaaagcggtgggaaagggattgaaagtgacggcggttgcaccggatggcgtggttgaaggcatggagtccacggataccgatctcttcctcggcgttcaatggcatccggaaaacatgtggcaacaggaggatccgcagcagttagttgtctttcaggactttctggatcgaatcgctgctcatcgcaagtaaatcagctggccagctagcacacgcatcatgatgaaaattgaatgtaaaaagccgtctccagtttttcaggatgacggctttttacattcaattgcttattactgaacgatatattcgaggctagtaatcttaccagtctgtcttttcctcagctactggtttgatattatcgagatcaccggtttcttgaagcagggaactaaaatcaacgtgatcaaacatgccattgaaccatggattgtcactcttttttcgtacatagatgagcttgctggcatcagcacttgccatgagttcgaacaattcgccttcatgaacagacagattgctgggaatagttaaaacgagctgattcccgtgtttttgggctttgaagacaccaaactggtttagtttatttgtcatgaacttatcctccgcaaattgtttttgagcaagcaagtctggggtgctggcggtctagtcgttacatggtacaaaaattatagcatgaagccagctgatgtggataagcgctgactttaatttagaggcttgtgatattgggctcaatactatttttaaatttgtcagcgcatataaagcaattttcagaaattctttcatttcaccaataatcatgtaagattgaaaccgagtgatgttacgtaacgggtgttgtttaagacggcgagcatgatgaaaaggggctgaggttagcaatgaatgaagaagctgtgattgagcaattgacagagaagcaaaccgagctgatcgagtttctgtatgtggattataacggcctgacacgaggaaaggtgatcccgcttgcgagtttaaaagctaaactggcagatggcattggcttgaccaaggcaaccttgaatgtcagcgagcgcgatacgattttaccggtgcaggatatgacgccaatcggggagttgcggctggttggcgatccggcgtcggctcatgtgctgccatacatgccgcaagtagccactttaatgggtgacatttataacctcgataaaacgccttatgcatcagatccgcggtcgatattgaagcgtgtcgttgagcagcttgcagatgctgggttcagtgtgaaaatgacttatgaaaacgagtttgagctatttaccggcgacaaggatcatcgggagcctgcgatgccgcgggttgctttttcaactgagtcgatggactttgcttatccttttattctcaaagcgattaatcagcttcaacaagtcgggattatgccgaatgcgtattatccggaaggcgggattggtcagcatgaattgagcatgttgccgcaagatccggtaacggccgcggataatgaggtgatttataagcggattatcaaaaatacggctaagaatttcgatctctatgcatcctttgcgcccaaaccgcttgtggattcggctggctctggagcgcatattcacttttcgttgtggcaagaccaaaaagatgctttttttgatgacgatgcgccgatgcatttgtcgcagaccggtcagtattttgtgggtggcattttgaaacacatccaaggcttgctggcattaacctgtccgtcagtcaattcgtatcaacgcctcgccccgggacattggagtagtgcttatgcgacatatggtcaggataatcgcgaagccgccgtgcgaatcccgtcaacggcctggagcgatccagccagctcaatgaacattgaactaaaagcgagtgacgccactgccaatccatacttagcgtttgcagggctgttagcggctgggcttgatggcatcacccaccaactacaacccggtgactattgcgatgttgatccggccagtcttagcgatgcggaacgcgcggcaaaaggtatccagcgcttgccgcgaacattaggccaagcagttgatgcatttgtagcggatccgctatttcagaatttgttcggcgctcagctggtagatgcttatgcaaaaatcaagcgtgaagatgaccactattatggcaagttggaactggaaaagattgcggcattgcatcgggaattgtactgattgtaggaagattttaagcaggcgctgatccgtacgatttcatttacccgcgccggctcgcgctcaccataacgcgttcaccggcgcagaagtctgcgtgtaaggaccttggtcgcaatgaccaaacccgggccatcacgcccaaggccacttacactccgacttctacccgcgcgggttcacgctcactttctttgaggaggtttcattttggacgacttaacggaatttgtcgaccaagtcccattgttggaccatcactgtcactttttgattaatggcaaagtgccgaatcgggatgaacgattggcacaggtttcgactgaagcagataacgattatcccttagccgacaccaaaaaccgccttgcttatcatggttttttggcgttagcaaagcagtttgcccttgatgccaagcacccgttagcagcgatgaatgatccggggtatgcaacctataatcagcgcatttttagccattatcattttcaggagttgttgatcgatactggatttgtgccggatgatgcgattttggatttaaatgaaaccgctaaattgaccggggttccggttaaagccatttatcggctggagacgcatgctgaagcgctgatgttgcagcatgataactttgctgcgtggtggcaggcgttgcgggatgatattcgccaagctaaagaacatggctttgtcgggtttaagtcgattgcggcttaccgcgtgggcttgcacattgagccggttaatctgatggaggcggcagcagggtttgatacctggaaacagtctggtgaaacccggctgacgtcaaagccgttgattgattacatcttgtaccacgcggcgccgctaatcatcgcccaagacctgccacttcagtttcatgttggctatggcgacgcggatacggacatgtatctaggtaacccgctgttgatgcgcgactttttaaatgtgtttgcgaaaaaagggcttaaagtcgttttattgcattgttacccgtatcagcgggaggccggttatctcgccagtgtctttccaaatctgtattttgatatttcgttgttggataatcttggtcccagtggcgtgcagcgggtgttcaatgaggcagttgaactggcgccatacactcggatactatttgcgtctgatgcgagcacgtatccggaaatgtacggcttagcggcgcagcaatttaagcaggcactcgtcgcgcacttttcaacgttgccatttgtcgatctagcccagaaaaaagcgtggatcaacgccatctgctgggaaaccgcggctaagctctaccaccaagaggatgagttcaagcccgcagatccgcaccgctaaaagcgagtttgctaatagaggagaaacaaacccattatggaaaagcgtaaaaaattaaccttacttgaggtctttggtctttcgatcgccatggtcgctcccactggcgccatgtcgtttaacaccgcaagtgctgccgccaacgccgggatcaacatgccgattgctttcttgcttggcggcattggtgtcttgtttgtggccatttcgtttgttgagctaggtaagcgcatccctggcgatggttcggcatatgcctacaatgccaaagcgcttggcgaaaaagccggcttcatttccggctggttgttggtgttgacctacgtgacctttgtgttcagttccggtgccattgtcggaaactttgccaatgtctttctgagtcacttaggcatccatttaccagtcaatttatacaatattatcgtcctgttgttagggggctggctcagtcataaaggcattgagttttccactcgtttgaccttggtgctggaattgttggcagttttagtgttgagtgtgttgaccgtcgtgattattttctccggcggtcgcagcggcaattcggtgcagccgttgatccctcaaccccacatggctaccggcttaggcatggggatggtgtttgctctgatgtcatttgctgggtttgaaggttcagcaaccattgccccgcgcgctacgaacccacgcaaggcgatcagtattgcgctgctgggggccgtaagttttgcggcgattttctatttcttggttagttacgcggaagtcatcggttttggctcggcacacattggcgatcttgccaaaagtaccgcgccaatgaactttctggcgacccattatctcggcaccaacgcggcaatctttatggactttgccgccatggtgagctattttgcctgttactttggtgcacttaatgctggagccttcatgctggaagcacttgggaaaagtgggtatctgcatccttggctggcggaagaaaccggggacaagcagacgccgacgcatgcacttgatagcatcacggggctggcgttgattgtgtatgtcatttttgcaatcggcttgggcgttagtgccagtgatatgtacaactggtttggtacgattgggatgctgggcttgctgacagtgtatgtgctggtgaatattggcgcgattgtttatttccgcaaagataaagggcgctcaatgttcaaacatgtgcttgcgcctgtcattgggattctggttctcatctatccgatctacaccagtctttggcccattccggcatttccaatgaacacttttccgtacattgcaatcgcctggttcctcatcggcctctgggtggcagcaaaaaggcgtaaggtcacaacgcgattagaagatttttaaatcattcctgaatccatcaaaaaaagcctgtcatcatcgcgatgcaggcgttttttgatcccatattgggtgtctaaactagaaacattttcaaaatcgtcagcggttttagtctgtccctgcgactttttcatgggccgtgccggttttgacgtatttttccgtgccatcagcgacggcctggcgataataatgctgcttgtattcaatcgtgttaagggtttggtgcagttgctgcatttgattttcaacggactcatgaagatgattgaaaaagtccagccgcttttccagtgtcgtgtcgccttccagcgtccactgcatgaaggtgcggatgtctttaatcgacatgccagcagttttgagacagttgatcatttccagcgcgccgagattgtggtcgtcaaaacagcgaaccccggcaggatctttcttgagatcgggaatgaggccttctttatcatagtagcgaatagtggggacggagagatgcgtgatggcggcgacttcgccaatcgaataagatacggacatatgaacctccaatggtgatgactaaagataatttaaaaaacagttgccctaaagttgactttagggactaggctgagtgtagcacttatcaaaacaagtgcaaaaaagttaatcatgctagggtgctttttcaattcgttgaaaacacccggcgaaagtcaaaagagggatgaaaacttgttagaagaaacgtatctattagccaatggggtaaagattcctaaaatcggttttggcacttggatgattgcagacaatgccgctgcggcaacggctgttcatgaggcgattgacgctggttatcgacatatcgatacagccgaagcgtatggcaatgaagtcggcgtgggcgaaggcgtgcgggcagccggtattgcgcggcaggacattttcgtcaacaccaagctggccgcagagatcaaggaacacgatgcagcagttaaagcaattgacgagtcgctgcaaaaactgaatttggattatatcgacatgatgatcattcacgcaccgaagccatgggcaaaatatgatgagcctgatcgttactttgaaggcaatctggaagcatggcgggcgctggaagaagcatataaagctggcaaactgcgggcgatcggtgtgtctaattttgatcccaccgatctcaagaatctgttggatcatgccgaaattgcaccaatggttgaccaagtgttagcacacattacccagacgccgtttaaaacgattgattttgccaaacaacatcacattctggttgaggcatattcaccgtttggacatggtgaaatgttcaaaaatcaggcaattcagcagatggcggaaaagtatcacgtttcagtggcacaattagggatgcgatatttattgcaactaggcctgttaccgctgccgaagacggtcaaaccggaacatatgaaggcgaatgccgagattgactttgagatcaatgaaaccgacatgtcaacgcttgaacacatgaagccattgacagactatggtcagtatcagtctttcccggtttatagtgatcggttaagttgagggcagggcattgattgcgtacaggtcaagatactgagacataattctatctcaggatgtgatgcacactaaaatccgaatactatagctgagaaagtagctaaagtagttccgtgtcgtgccaaactccgcactctccggccagatggggctggaacgctgtgacggcgcttggagcctgcaagcccggcagtctccaagtcgcctaacaacatcagcgacaaaacccggtcgctgtgttgttccacggctgagccccatcaggcctacgattgctccgctttggcactgggagcattaaagctcatttatactaataagaaaaagtcaaaacgcgtactactttctgaaaaaatcagaaatagtacgcgctttatattggagcggtgaattatggcccagcctcttgttggtcaactttagacgcatacactaactcttgtgaagttttaaatactgtttcacccgcaatgcttagcgatttggtcctgctttaatcacccttaggcgtctatatgccagcaattatgcccacggtccggcaaccacaatcttaccgatcatgtgtccggattcaacgagtgcatgtgcctgacgtaaatttgtggcattgagcggctgtagtgttttggttaaggtgcactgcaacgtacccttgtcgagaagcgcggcaacttgatcaagaatggcaccttgcgaatctagttcatagccataccaagactttgagaacatccactcccacacaaatgtggcccgcttcttagtgagtttctgcaagttgatgccgtggcgattttcggtaatagccgcgacccaaccatcaggacgaatcatggtggcgatctcggaccagtgttcgtctagatgcgacagattaaggatataatcgacatttttaaacccggctgcctttagctgcggtggtaatggcttgcggtggtttaaaacgtgatcagcaccatgatcctgtacccatttttgtgattcgggacgtgaagcggttgccagaacctgcagaccggccagatgcgctaactgtgtcgccatggaaccgacaccgccggaaccgttgataattaagatcgtatgatgccgattttctgcagttgcattcagggaaatgtgtaacttttcaaacaacgcttcccatgcggtgagactggttagtggcatggcggctgcttgggcatcgttcaggttcttcggcgcgtgaccgacaatgcgttcatcgactaactgatattcggcatcgcttccggagcgtttataactaccagcgtagaagacccgatcaccaactctaaagcgcgtgacatcttgacccacagcattgacggtaccaacagcatcccatcccaacactttaggctgagccaactgcgcgtgccctgctcctcgtgtacctgtgtcaacaggattaacagacacagcaagaacattcactagaaggtcgtgaccagtgggggttggcttagaaagggtcagatcttctaaactacgagcatcttgaatgggtaaatgttgcgtaaaaccaattgctttcattgaagtagcttcctttcgctaagtttcaccttgtatgttagcgggcatgttctaaaatagtaagtgagtaaattgtaagtaacttaaaaaaggaagtcctatgatgtcaggcgaactttatgattgtgcggctgggtgtccagttcaaaatacagttgacattatttcaggtaaatggaaaagtgtgatcctataccatctttttcagggtgacgcgacacggttcagtacgcttaataaagccatcccatcagtaactgaacgaatgttggcattacaattagcacagctagaagcggatcatgtcattactaaaaagccaggtgacgccgatggacgagccacagaatacggactaacagaattcgggcagacactggcacctgtgatccaagcaatggcaacttggggcgaggcttatcaagcacgacaaaaagcgaccgcctgattggacatattgaagatgaacattaaaaagcatcgttggaatttttgagtggttcccaacgatgctttttatgttataaatacgcctgatagaacaggaaaaccgcaagcccaagtgcaaagatgccgacagcagttttaataatgcgagatgggatcaagcgaacaatgaccggtccgagaaaaccacctgcaaataaaccgatgcagactgggattagaacaccccaagcaattggcatggagaagataaacatgatggatgtcaccagattattcaccagtgaggcaaggttgcgcatggcattgtaggtggcataagggccttcaacaagtcgcgaaagtacggccaccatcaacagtccggcaccggcaccaaaatagccaacataaataccgactaacatcaccagcacatagccaaaccaccgcaagtgctgacgcgtagaactgttactgcttgcgggtttgggtggcattagaatcaagacgccagccaaaaaaatgataaacgggacgactcgtttgaatcccgcattggaactatgaatcaaaataagggctccaaaaacgccgccaatggtattaagcaacgtaatgacaagcgcctgatgccagtgaccttttagttcgtggcgagaagcagcaaccgcagatgagccgctaaataaaagtccaattgtattcgtagcgttagcggtaatcggcgccacgccaactgacaatagcaccggataaagcgtgagtgccgccatcccgacaataccgttgagaatgccggccagtagactcatgcctagtaagaaaaggatggtttcgattgtcatggattcgcctccttttgctttagcagagattatatatctttgataccagaaattcgttaatagtgcatcttttacacatctgaaaaggtgattcaattgatgttagtgtgcggtcgttttgcatgataagcaaaataattgaatgatacggacttcatgacataatagatggaacccaacttacggttaaattgagtaaaacgcattgacgtctgaggagcttttatgactaagaaagtttaccgccttctcatcccaaccctaacctttttctacctatggcttgccttaggtggccttgatcaagctgcaaaactctggcttaaactggtcatcatcgcaatcggggcctttttaagtctgctttggattcgaatggtacggttgccgccttttcgtgaggtgcggcacttgtggcatcagattgagacgctgcagtttatgattgtttctgatccgaagaaccggctagatttgttgaagcggcgcgtttttgccgatcaggcgcgtcattttcgcgggttggccgtttatagttatgtcttgagtatgctgtcagggctgattttagatgggctgggatttgtgcgggtcagtgattttgtggtgacggtgggatggacattagcgttgatggtgctcatcacggtgtatattattggcgccattcaggcatttgccacgcacttaattcgaacctttgtgagtttgcagctgtttgccccgttggctttgctgattggcctgaatataaccggaatcatgcctgacttcagtgcttttcgcgattatattctatattacctgctgttgagcatcacgatttctgcggtgatgattgtgatggtgccgaattatcagttgcgggtgttgacgaattatattcctgcgattaatgcgacgagcacggtgatcatttttctactggcggagtttggcaatacggcgatggcaggcattgcgcatcagattagtcacgggcttgatttatcgccgacactgacggctagtttgtttggtccgaaaatgattgcggcgattcgcgaattgctaacgctgatcagtattgtgtttctcatcagcggcaacgttatttccgcggtgatgacgcattatcgagtgaagagtgaaaatcaattgaagcaagtgctggctgacatcacgcttccgatttcgtcaacggattatcaagggttgcgatcaattgtttatcacggattagcttataatgcgttgttgattattggtcggcgtgatctttatcaggctattcgcacttatgaacagcagcatggcctggagccgcctgcagaggaagcagcgcaatccaaacgtcactggtttgaatggttcaaacgacattagccttggcagacaccttgggtaaaatcacattcgttttttaaattagttttgccatttaggcggtataggcaaaaatggtctgctatacttagaaaaaatctttggattgctaagaaggtgagcccatgaaacaactgcaaattgcacatttggataaggcgtttgatcaacaggttttgtttaaagatgctaactatacgtttaaacaaggaaaaatctatggcttgctagggcgcaacggttcaggaaagtcgactttatttaacatgattgtgcgtaacttgccgcatgatcatggcacgatcgcaattgatgccgatgatggtcaaggattgatcacggattatgcggacacatcggtgggcatggtttatacccaaccgcatttaccggcgtttatgaccggggtggagtttgtggattattttatagcgattaatcggcagcgccttgagcaaacccacacgagcgttaaagcggcggatttcttttcattggcggggttgtcgcaggcagatgccaataagttgttgcgcgattattccgaggggatgcgcaataagttgcagattgtggtgtcgttgatgcttaagccgcccgtattattgttagacgagccgctgacgacagtggatgtggtggcggctcatgaaatgcagcagatgattgtcgcgatgaaggccgactcggtggttgttttctcgacccatattatgcagctagcacaggccatttgtgacgcggtggtgttgctgcatgataaaaagctgagcgaactggagggcctggatattcacagtcaggaatttgaagaggctgtgattgcgcgtttaagtgatgaggtgcaggcagatgcgtgatgcttggcgatattactggtttcaggcgcaggtcaatacaacaacgatggtgaatgggttcatttacttcttgcggcgaattccgtttctgggtaaaaagatcccgacaaaatggtaccggccaagtgcgttgaaaacgatcatggcaattgcagttaactttttcacgattttgctaaaaccggtgacaacgcttttgctgatcgggctagcatttttggttggtagtgcgtatcacgattatgtgcatccactggcaaccgatctttcacttcgcgtcatgatcgcggtactggtttatctggtgggttttctcatgtttcgcggcttggtattccgcaatctgccgctgagtctcaagtcggttaaactaggggattattttgccttggatcggccggcactggtgcgcgggttgatgctgatggatcaaatcagcggcgttgtacttgggccactactgcctatgtttgcgctcgccttgttgacgcagcatatgtggctgtttttggttggactgccgattgccattattgggtggttatggccgagtttcattccacggctgctgtgggcacactggcggctgggattgctggtgcagattgggtattggctgagtttgctggggctacccattggcttagtagtaaccggaaaattagccgcctttacgtttggcgttttttcgccgctgggctttctgattgcatgggctagtgtggtgctgattgggtggtacatttaccgtttttcgaatgataattcgttaatcatggcctccattcagtctgcagtgcgggcgttaaatcttgttgcttcagccaaaaagcagcaacttctagcggcaggaactgcaatgcaaaagaaactgacgctggataccaccgtggccctcaagtctgaaaaccgttccggcagtaattatctcaatgccttgttgtttgcccgttatcgtcgccagctatggaaaaagttgcggacccgtctgctgtgggttattggacttggcggtgggcttttgatcgcattgaaacttttcgctgtccataatttaggcgatctgacgccgatttatggtggtattttctttttgatgtatttgacctcgctgggtggccaaatcgttcaactgttatttgttaattgtgacgcggcaatgttgtattatcctttttaccgccagcctaagaccattttagccggattcttttatcggttttggcacattgttcaatacaatgcagtgactgggttcacggttttcctgctgatttttgcactgcagttaatcgcaccggtagccgatcaggtcaacttttatctggtgttgttgctggagatctgtggtttggtgttgttcttttcgtttcatgatctctttatttattatctgatgcagccatttacggatgatatggatgttgtatcgccgctgtaccgcttcttgtcctggggaatgtattgggtggcttggatttttacacaagttcatttttacggctatggttatgccatcctcattggaacgatgacgctgctttatgtcgggatcggtaccgcggtgatttaccgagtggcacctaagactttccggattcggtattaatctggccgcgtttagagtggaatttaatgttagttcatgagcactgccagcagctggcagtgcttttttaatatcacctagcagatgccttgttgcaagcggttgcggcaacaggtagagttgaattaggaaacacttattttgcaatgaatcataatcgatataagtgcggagctaataggcttggggtaatggagggtgaaggcatgaagaccaaggtactggcggtggatgatgatactgctattttggcaatgttaaagcgatactttgcgtggcggctaccggagtttcgattactgacagcagatgcagggcaagcagccttgagtcaattggcgcagcagcccgacttgattttgctggatgttaatttaccggatattgatggctttaccttaaccagtcgaattcgtgcgatcacttctgtccccattatctttttaaccgcacgtattaccgatcaggataaggtgcaggggttaggcgcaggcggtgatgattatgtgaccaagccatttagtctgacggaattaggtgcacgcatcaaggcacatgtcagacgtgcccatcagccggacaaacaggcgcagattgccgtttttggacggatcatgattgattatcatgcgcatcaggtctcggtggatacgacttgcctaaaacttgaaaataagcaatatcaactgattgaatggctgagcctgaatccggggcaggtgtttagccgcgagcagttgtatgaaaagatttggggctacgatgcacaaggggatgagcgggtgatcaccgagcacattcgccgcattcgcaagctctttgatgcctgtcaggtaacatcgcccatcgtaacggtttggggagtgggatataaatggcaaaattaaaagcacactttatgaagctatcgattaaaaaagcacttttacagatgattctgctgggaacgattgtcgccggtatcatgatgttgctatttttacaagtctggcatttcttgatgtttcacttgacgacagctttagcgactcactggtttttaggcggtgtcggtttgtattttggcggagcgattattggtagcttcgccgttttatatgcggttatgaatgcaatggcgcggatggtttatcggcttaagtttgcaccgccgttagcccagttaaaggcgggggtggcacatattcaggctcaggatctggattttgaactgcatgccaagacaaccgatgaactggggcaattggtgggcgcatttgaagcgatgcgccaagcccttcgtcaagcacttgaagaagcatggcagttggttgaggatcaaaaacaggtgaatgcggcttttgcccatgacctgcgaacgccattgacggttttgcaaggcaacctggaacttttgaccatggcggataaggatgagcagccggatcaggcactcttggctgagatgcaccagcagttggatcggatgacggcttttatccaaacgatgagtcatctttccgcgcttcaaaaccgtcagctaaccggtgaggcgatgacgccggccaccttggaacaacaacttaaagaagaagccagcaaacttgttccggccaccaagacggttacttggaaggtcgagaaccagctgacaacaaacgagtcgcttgcaattgcaccagatgtggtacttgaagttttcgataatcaactgaccaatgcttgtcggtttgccgctgagcaggtggcgattcacttaaccgcaacggcaaacgggttgacgataaaagttgataatgatggtccgccgttgacgccgggtgaacaagctaaagccaagttgccgtatttttccagtgatcgtcaagcccaacatctcggggtcggtatgtacatctgtacgcaattatgcgcggcgcatcggggtcattttacaattgccaatcaaccagatacccaaggcgtcagcaccattgccgaatttggttttttaacgcctgcctccagctcgactgattgatccgattttaggtaaattggttgagttgtcagaaaattgtcatttacttgttacagtctgcttatcaacatgatgcgtctgccaatttagaaattgcaggtgagaaaaaacgggtgcctttactgcacgcggttctcacagcgcggttttgaacaaactggctcgcttcatggataaggaggctttttttgatgacaacgattcagattgagcagttagtgaagcaatatcgtggccgacaacagccggctttggatcacgtttcgttggatatccagtcaggaatgtatggattattggggaaaaacggtgccggtaaatccacgttgatgaagattttgacaacacttgagcaacctacttccggtaaggtgttggtggatggcacaccacttaaagatgcgcgcagtattcggcgcaaaattgggtatctgccgcaacagttcgggttttatccaaccatgaaagttattgacgcaatgacctatttggcaatcttagctgaggtgccggctcgcgagcagaagcggcgaattgagcggttactggcagctgttcatttgacagctcaggcgcaaacgaaagtcaaggcgttgtctggcggcatgttgcaacggttaggcattgcgcaggcgctcgtgaatgagccacgggttttgattgttgatgaacccaccgcgggactggacccggaagaacggatacgatttcggaatttgttggcagattttgctaatgagcgtttggtactcttgtctacccatattgtttccgatgttgaggcaacgactaatcgtattggcatccttgatcatgggcgactggctttcaatgggaccactgacgagcttattgatgcggctgcggggcatgtttttgtcggtgacttaccggtggcgcagcttaaacagtttaagacgcagtaccagattagtgaacaaacagcgcacgggcagcatattcgggtacgctttttagctcgtactccgttggcaacttggcaatcggttgcgccaacactggaggaggcgtatctgtatttacaaacccagcatcatcaagcgttggtgaagacggtaagcggtgtgtgaggaggggtcattgtgaagctgctttggatggaatttaagcggcagacgcgaagtttaacgtttgttatttacacatttttagtcgtggcatttatcgtgatgaatgtctggccattactttcacgaaacttaaccaccctgccgaaatcaccagcgagctacgaaaacatcacggcgaccgattatcagacgctcaagacaaacagtctggatcagttgcactacgattatcggcacaatttgtatacgacttatccgctggggtttgcaaaacaagtgacgttacgcgcggcagaccaggcaaaagttcgccagttgatgactgaggcggaggatgcagacacgcgcgcacccttggttaaaacgttggcaaaggttgaccggctcttgggtggacagtctgcgtacagttcacaaaatattcagaattttgcttatcgccggatgacgaaagccgaagtcgtcgcggatcagcagctcattcggcaacgtgatcgggtcaccggagcgtttgcgagattgtttgcggatattgccggaatcatgatgggcattttaccgacaattgtggccattgctttttgtactgccgatcgccggcatcatgcgtcggcggtgattcaaaccaaggcgatgaccacgtcgcgtttattattgacgcggtatgttgcgagtttaggaagtttatttgcgccagtgattgcgatcgccattgcgttgacgattcaggtcgccgttttataccaagggatgtcgttggattatcccgcgattgtgaaaatggcttttatctgggtgttaccaacgctcatggtcagcagtgcggttggctatttaagtgcggcgatctttggtaattttattggttttggcattcaaattggctggtggttggtaacgatgatggcgggtgctcgccgggtgagtggtaactacggatggttattgatcccgcggcataattcgctgcacaatggcgcgtattactatgcccatttaaaccagctgttgcaaaatcggctcggatacgctttgttggcgcttggactgatggcgttaactgcttggatcttggctgcacaacggggaggtaaactacatgcgctcaagtttaggccgcttcgtccgattagaaattaaaaccaacgtcttgaaaaccagcctcattgcggtactcggctgggggctcattccgattgtttttacgctgacaccgcagagtctggcacaagcagcgatgccgactgagttgtggatgccgctgctagcgatcttttgttttggcagcttatttttaccggagcaaacaacaggggtagcggcagttatcaatagtaaatcgatccaattgtggacggtttacgcggtgcggtttgcttggtattttggcgtattggcagtgctaaacgttacgctgcttggtctatatcagattcagggaacgacattggctgctggcgttctgttgggcaatgcgctggttaagagtttatttatcgggagcatcacgcttggtagttactgttgctctcagtcacttgcggtggcgtatttaattccgaccgtttactttgcgctttgtattggtagcaatcaattaggggcgttaaacttgttgaccttaatgcgtcagcgaccgttaagcgataattggttacaactaggagttgcggcgcttttcatgatcattagctttcttttggcgcggcggcgattggtaaacagttgaaaatagttgctgcatgcaggcgacttgagcgtgtgactttctgctacaagcggtaggccacttggcgtataataagcgtgattaacgttatcatcacgcgtttgccggtgtaggggattaactgcttcggtgcgcgtttcatcagcacgcgctccggctctcaaccgtgctggttcgcgcttgatcataacgcgctcaccagcgcagaagtctgcgtgtaaggacctcggtcgcaatggccaaagtgcggccatcacgcccaaggccgcttacactccgacttctcccgcgctggttcgcgctcacacacaaggaggaattggtgcatgactgtagcaacgcatttttatcagttgtttcaaccggaacattacgatctttacttggatattaaccgggagacgaagaagatttccgggaagacgacgattaccggtgatgccaagcaaaccgaaattgcggttcatcagaagtatttgacggtcagtgcggttcaggctgacggcaaggatgttccgtttacggtggatgatcctgccgaagcggtgcggattactttgccgcaagctggcaaggtgacgttgacactgacgtataccgcaccgttgacggacaccatgatgggtatttatccttcttattacgaagtggacggggttaagaagcagattatcgggacccagtttgaaacaacggctgcacgtcaggcgtttcctagtgtagacgagcctgaagccaaggcgacgtttgatttagcaattaaatttgatgaacatcccggcgaaacgattatcagtaacatgccggaagttcgtgaagaaaatggcgttcattattttgacaccacggttcggatgtcgacttacctgattgcctttgcatttggtgaattgcaaaataagcagacaaccaccaaaagcggcgttaaaatcggggtctttgctaccaaagcacatcgacctaatgagcttgacttcgcgttagacattgccaagcgctcgattgaattttacgaagacttttaccagacgccttatccgctcccgcattcctggcagttggcgttgcctgacttttcggctggggcgatggaaaactgggggcttgtcacttatcgggaagcgttgctgacactggatccggacaacacctcgctggaaaccaagcagcgggttgctaccgttattgcgcatgaactggcgcatcaatggtttggcgatttggtgacgatgaagtggtgggacgatctgtggttgaatgaaagttttgccaacatgatggaatatgttgcggttgatgccttgcaaccggactggcatatttgggagacattccagacgctggaagtaccaatggcgttgcaacgtgatgcaacggatggggttcagtcagttcatgttcaagtagaagatccggctgaaatcgattcgctttttgacagcgcgattgtgtatgcaaaaggtgcacggatgctggtcatggtacgttccttaatcggtgatgatgcgctgcgggccggcttgaaggcgtacttcgaagctcatcattttggcaatgctgccggtgctgatttgtgggcagctttgggtaaagcggctaagttagatgtcggcaccatcatgcagtcatggctggaacaaccaggctatccagtggtgacagcagcggtgattgatggcaaactgaccctgtcccagcaacaattcttcattggtgcaggcaaagatgcaggtcggcaatggcagattccgctcaatagcaattatgctgccgcaccgcagatttttgcggataagcaggtaactttgggcgattacacccagttgcgcgaagcaagcggtcaaccattccgcgtaaatgtgggcaataactcgcatttcatcgtgaaatacgacgccaccttactcgccgatattttggcacatcttgaccaactcaatgcgattgatcaacggcaggtgcttcaagatttacggttactggcggagggccggcaaaatgcttatgccgacattgtgccgttgctgccgcggtttgcccagagtcacagtgccatcgtcatcaacgccttgtatcgggtggccaatgacttgaaacaattcgtcaacccggattcagccgaagaaacgcagctgaaaaccttcttcaatcaaatcagcgccgaccagttcaagcgcctaggatggacaccaaaagccggcgaatccaatgatgatcaattaacccgtccttatgtcctaagcatggcgttgtatgctaagaataaagacgccattgcgcaaggtcacgatctatttacggcaaataaggatcacctgcttcaattaccggccgatgtgcggatgtttgtccttcaaaatgaagtgaaaaacttcggcagtgccaccttgttcgatcagttgttaacggcgtataagcagacaaccgactcaagctacaaagccgatattcttgcagcgttaaccagcaccccggatgccgcgttaatcgctaaaattgtggatcaatttgaaaatgccgacaccattaagccgcaagatttgcgctcatggttccgcggcgtcttgagtaatcacgccggcgaacaagcagcatgggattgggttcgcaacgaatgggcttggcttgaaaaaacagttggcggcgacatggaattcaccacctacatcaccgttatcgccggcattttccgcaccacgcaacgacttgatgaattcaagaaattcttcgagccaaaactaccgacacctggcctaacccgggaaatcaccatggacaccagcgttattgccagtcgcgtcgatctgattcaagcagagcaacaagctgtgcatgaagcagttgccaaagctgttaagtaaaatattagccgtcttggctgatagctaaagagaaatgacaaaaggccgccactcagcgttacagtggcggtctttttataccttcatacttccagttaatgagtatccatacggcatgaaataacgaaaccgcaaccgggcttttagaaaaatctaatccttatctatacaatttcacgggaaagcgaggtggtcaaaccgttacactgaaaagcgagtaactgttcctaatcgagcaggataccgtttggagggatgtttgtggcagacacaaagaaacaactgcgctggtataacgtggccttaatcgcgttcgtatcggtttggggtcttggcaatgtgttcaataactatgcacaacaaggcctttccgttgtcactagctggattctgattatgctgatttattttgtgccctatgctttgattgtggggcagctgggatcaacgtttaaagatcaagccggtggcgttagttcctggatcaaggaaaccggcagtgtgcgattggcgtactatgcggcgtggacttattgggtcgtgcacatcccttatttagcccagaagccgcaagcgattttgattgccttgagctggctgtttaaaggcaacggtgattttatcaacaccgtctcgtccatgaccgtttccttaatctgtctggcgttattcttacttttcctttggctgtcttcgcgcgggcttaccaccttgaatcgcattggcagcatggcgggcacggcgatgtttctgatgtcgattcttttcattattctagccgtgaccgcaccgttgatggtaaaaggcgtccatgtggcgactccgaacatgggcgacattcatacttatttgcctaaatttgacctcaactacttcacgacgatctccatgctagtctttgcagttggtggggcggaaaaaatttcgccatacgtcaacaataccaagcacgcctccaaggaatttccgttgggcatgctggtgctggcgggcatggttgccttttgcgcgttgctagggtcttttggcatggggatgttgtttaacagccaccacattccgacagatctcatggcgaatggcccatacacagcgtttgcaatgttaggtaagtattatcacgtcggcggtttgtttgtcattttgtattcaatcgccaatgctttggcctcaatctccgcgttggcattttccattgatgcgccgctgaaaatcttgctgagtgacgccgatccgcattttattcctaaaaaattgcggcggatcaatcgcaaaggcacgccgattaatggttactggatgaccggtattctggtaagtctgctgatcattattccggcgtttggaattggcaatatgaacgagctttacaagtggctgcttaacttgaactctgtggtcatgccgttgcgctatctgtgggttttcctcgcgtattatttgctaaacaaacatctcgaaaagttccaggccgactatatgctggttaaaaataaacgcatgggcatgctcgtgggcggctggtgcttcttcttcactgcctttgcctgcttattggggatgttaccgaagatcagttatcttaatgatcccggcacatggtggttccagatgggcttgaatattattacgccggttattttgttggcattagggctgattttacctgttattgctcggcttcatgaaaatgatctggatgctcagtgagataaaaaagattcaacaactgcctttagggaagtcgttgaatctttttttgtaagcgcgagccggcgcggttagaagtcggagtgtaagtggccttaagcgtgatggcccggtcttggccattgcgcttaaggtccttacacgcagacttctgcgccggggagcgcgttattgcgcgcgagccgatgcgggaaaaacgtattggcatgtgagcgggcaaaacattagcccatatcattgctggcggcctaagcctgatgtttttcaatcgcagctaacatctgcttttccggataaaagtgaatcagaagcagtaacaggccgtacaacagcaacggcaaccaaacgtaattcaggttaatcatgccaagcgttgcagcattttggctggtgttgggtacgtatccggcaaggtcgaacaatccagcggtgatcaggccgccgatgccgagtcctaagttaacgccgaaatcgttgctggaggcaaacaaaccttcagcttgagcgccgagagtaatgccatagcgaatcgtatcggcgagcataatcgacaccaagccgacaatcattccttgaccgatgctgttaatcagaatgccaggaaacaaaatccacaagttccgcgcataaacaccgcctgcaatgacgaactggccgattaaaccaatgatcatgccaaggcgcatcgtgtgtttattcccatgccgacctgcaatcgtccggattaataaaacaccgatcagcgatgaaaacgtaaagctattggcccaggataccaagccttgattgtgtaaagtgtacttgaaatagtaaaccgtggtctgatttttaatcgccgtcaacagccagtacgtaaagataatgagcgacagcaacaaccacggccgatttttgacggcaattttagccacgacttttagcggttggtgggcgattttttcctgcgtgaaccgttcgcggatatgaatgaacgtattcagaatcagcaccagcgagatgccggcaaatagggtcatggttaagagaaacccgcgctgatcattgccgcggccgaagaaagcaaccaatggcaacgtgaaaaccgcgacaatgatttgcactgagctaccaaagaattgacggatgacgcccagtagcgttaattcctgtggttgttgggttaacgttggcagtaccgaggtaatgggcagattcaccgccgtatataagaaaccgaggacgaggtaagtgacataagcccagatgagtttgccatttgccgaccatgccggcgtgacgaatgttaagacggcaaaaatggcatacggcaaagcataccaaaggaaaaatggccggcttttcccaaagcgcgaatgagtacgatcaatcattaaaccgacaatcggactctcaaaaacatcggcaatacgcgcaactaaaaagagtaaggcaacggcgccggcttgtaagccataaatatcggtataaaaaaacaacagataggtggtcatcacctgaaacaccagattatctgctgcatcgcttaaaccatagctaatacgttccggccatttggtttgccaagaagtagacggttttgacacagataccgctcctttcttagatgcgattgaatggcgaatcagcatgcgggaaaggttcagagtatgattgctggagcgaaaatataaagtgcgccatatacttttaccctgactggctcgcactcacgatcgtcattgtttcaatgcctgcaaaagagactaatcgtgtttttcccgtagcatgtcactgatgacgatttggttgacggtattccagaccatgtgtcccactgcttcggacagatgctcttccactggctgatcttttgcgtctgggacgatatttagtgcaggcatggcccataaatgcgcgccggcccaaacaccaagtccccacatgctgccataacccagtttgaacagcggaacataatgcccggcaactgcgtaaagtgcgcctaagcttgatgaaaagccaaaatgaaccagtagactaacccaaggaacttgatggcctgaataggtgtaggttgcatgcgtctctgctggcgttaggccatgttgttgtagaaaagtttgcggtggattagtcgcatcgcgttccggtgtgcgcggcggcaggatattttcccaccctaatttgactaaaccagaaaccaaccctgcgacagcgccaactgcggctaatttaacgatggaaggtgatgtgtgcgtacgcatgataacgagacctccttcaaaatttgaaactacttccattttagaacaagccgtaccaatccgggagggcagggacccaaaaatataagaaaatttttgtgagtgcatgcatactattatggcttcataaacttatattggcgtggtgttgatggacaaactcaatgaaatcagtggctgccggagcctgataatggtcatttaaggttgccatgtagaagattcgttgccatgttggaaagcttaatggaatcactttaagcggcaaggtttgcagtaatggcatgttaggaaccacagcaatgccaaaaccattcgcgaccaatcctgcgaccgcttcatcttcctcaatcgaataaacactatggggttgggcaccgcactcggcaaataactggcgaatgatcggggccagcccgctttttttagaaaaggtaatctgatcgaatggcagggtttcacttaactcgatttgcttgcgctgagcgagaggatgattcaccggggtaatcacgacaagcgcttgcgaggcgatgggaaaataggcaatatcttcctcttcgtcaacttttgagcaaaagcagatgtcatattttttggcccgtaatccttgaataattttgggtgaaagtccgttttcgttcgtgaactcaaaacgaacatcttgggaccgagtttccaagaaatggcgaaccatacttggtacccaccttgtactaagcgtgcggagtgctgctagcttgatcacggtttgaccgtgtgcttgatgttgcagtcgctcgataccactgtcaagcgtggctagcgtatgactgacagtgcggttaaactctcgaccggctgcagttaggatcatgtgacgaccttgacgcgcaaataaagtgacgccaagctcggcttccaaaccgtgaatagcattgctaagactgggttgcgtgatgtgaagttgctgggcagcatgggtgtaattttgcagtttagccaatgtggcgaagtagcgtaagtgaaaaaggttcatgatttgcctcctgatagattaaacctgaacaatagcctaagactataattaccctcattataatgaattagaagtgacttgtgtaaccgtatacaatcttatttgtaaagagattgaaaaaacaatcacaagcccagcctgacatgcggatacacatggtgcactggctcgcgctcaccataacgtgctcgccagcccagaaacctgcacataaggaccttggtcgcaatgaccaaagcccggtcatcacgcccaaggccgcttatgctccggtttctaaccggtctggctcgcgctcacacaaaatgaggaggaattggttatgtcacagttacatcctattaccgttagttcatggactttaggcgatcaatgcacttttgaagatcgcgtcaaagctgctgcagcggctggttacgatggtatcggtttacgggctgagacttacgttgatgctttgaatgaaggactcaccgatcaagatattttggcgattttggaccgttatcacgttcgctgcactgaagttgagtacatcgtccagtggtgtgaagaaccgcgcagttatgagcaaaaatataaagagcaaacatgcttccacatgtgtcacttgtttggcgttgaacatattaataccggtttaatggaaagttactcagttgagtttacagcggagaaattaaaagcattggcgcatcgggcttcgctggctggtcaactcatcatagcccttgagccgatgccatatagcggcatgccagatttaaagaagacttgggcgattttgcaagcagctggggctcctaacgtcatgatgttgctagatatgtggcattgggttcgtgccgaccaaccctttgacctgctgactaaggaacaggccaagcgagtcatttccattcagcttgatgatgcgtataagcggccgtatgcgaagtcaattttacgggatgaatccatgcacgatcggctcgccccaggcaccgggtttgaagatcgtacggaacgctttatcaaaatgattaaagctgctggcgttgatccgaaagtcatcggagtagaagttatttccgatcaatacatggcaaaaggaattgattgggttgctaagtacacttatgaccacactgttaaaacgttacagacagcttggccggaaattttacaagatccagtagcagcacattaaacagtagcacgctttgaaaaaatgaaacgcgtattttggtatcaatatcaggcacgcaaggaggtaaatgatgacagactggttaggtttaaaagataaagtcgtggttgtgacgggcgctgttggcggcatgggaacgcatttttgccaggcgtttgcagaacatggcgctaaactcgcattagttgacatcaagcatgatgcagttgcagcagcagctaataagttaagcgatcaatatggcgtgcaaacattggcgttggctaccgataccactgatgaagatgaagtggatgcggcggttaaagcggtcgttgatacgttcggtcatgtagatgttttggtgaatacggcggcgattttacggttttcgccatttgaagatttgcgtttagatgagtggaagacagcgttgaatgttaatttgacgggttactttttgatgtcccagcgctttggtcggcaaatgattgtccaacgccacgggacaatggttcacatttcaacggtggcagcagttttcccggaaacttatagcggggcatacagtaccactaaagccgcggttaatatgctttccaaacaaatggctgcagaatggggacaatttggcattcgcagtaactgtgtcatgccatgtctcgtgaagacgccgatgtcagctgatttctataaagatccaaaagttcgcgaagggcgggaacgtttagtagctagtcggcgaattggcgatttggatgacattacgaatgcggtgttgtatttgagtagtgaacgctcggcatatactaacggcggcgaattacgggttgatggcggtctcggtatcatgatgcaagacatgattcctaaaccaggtggccggcgtgaatatgcgattaaggcacatcagcctcaaaaataggcagtaaaaataagataaaacttggtgcaagttggccaagttcttcttttgcggtggatagtgaatatatgaacatgccttgaacgatgatttgatgatagcgcgctgcgacttctaaccgcgccggctcgcgctcaatataacgcgctccccggcgcaggagtctgcgtgtaaggacctcagccgcaatggccaaagcccggccatcacgcctgaggccgcttacactccgacccctaaccgcgccggctcgcgctcactttctttgaggaggttttttaaatggaaacttggatttcaggaacgacgcaattgctatgtctgcttggcagtccggtggggcattccggttcgccggcgatgtataactttagttttcaaaagcaaaagattgatgcagcatatgttgcatttgatgttaaggaggatcaaatgccggatgcgctgaaagcaatgcgattgttcagaatgcgtggcggcaatgtcacgatgccatgtaagaatgtcgcggctactttgatggatgagttgtcaccagcagctaagattattggggcggttaacgtcattgtgaatgaaaatggccgtctgattgggcatatcacggatggcattggatttgtccggaatttgaaagaacacggcgttaacgtcaagggcaaaaagctagtggtattgggagctggcggtgcagcaacagcaattgaagtacagacagcacttgatggcgctaagcaagttgccatttttaatcgacaagatgctttctatacgcgtgcagagacgactgccaaaaagttggctcaagcagcaccagacgtcacggtcacggtagatcacttggaagacgatgctaagctcaaggccgctattgcccaagccgatatattggtcaatgccaccacagttggaatgaagcccaacgcaggaacttcattggtcgatccagcatatttgcggtcggatttggtggtagcggataccgtttatagtccgttgaaaaccaagctaattgaagatgctgagaagtgcggcgctaaaacggcaccaggtaaaggcatgttgctatggcaaggggcggcgggttacaagttatggacaggacaagatatgccagttgtggaatatcaggcttttgaagcgagtcattaaatgaaatgttttgcgtaaactgacggtagtcgcggaacttgctgtcatagcgcgttcaccggcgcagaaatctgtgtgtaaggacctcggtcataatggccgaaacctgggccatcgcgctcaaggccgcttacactccgacttctaagtgcgccggttcacgctcactaggaggtgtatggatcgatgaggaccaaacataatgtgtatttaccaggagcactggctttgtatttttcatatgccatgctaggagttgcgtcttccattttgagtcaatataaaggccagtttgcttctaactggggtgcacaggagttggcgaatgggactgttgatgtcagtatggttgtttcggtgattgcggcgtttggattgggtcggttgttagcttatccctttgccggcccggtttcggatcattttggacgtaaagtttctggcaccatagggattggcttgtatatcattttctttgttgggattatcacggtacatagtttttgggcagcctatgcgatcggcgtgctcaatgggatggctaactcgtttttggatacatgtgtgtcaccaagtttgatggagatgttccctgaatcagcttcaattgcaaacttattgactaagtttgcagtggtgatcgcccagtttatcctgccgttctttatcggaggcgtggccgctgcagggtggtcatttcagacaatctttatcatttgcggcattgcgttggtcatagatgcgctcgctattttgctgagtccgtttcctaaccgtgacctacctaagacgaatgctgccggacaatcggaaaagatgcacttttcgctgggagcggttgcagcaattttaattgggtttacaagttcgacgacatttatggtttggctgaattgtaatcaggaactaggggctgcttacggtgtgaagaatccggcatcattacaatcgctgtatgcagtcggcgccgggattgcggtgttgctaacagcacgtttaatcaaattgggtctcaaggagagtacagttttagtcgtttatccggtcatttcagtcatcatgttgctactgtgttactttattcaaacgccgagtattttgtatattggcagttttgttattggttatgcggctgcaggtggtgttttgcagttggcaacttcgacaacgattaacttttttccgaatcacaaaggcactgccacgtcactggtgatgattgcttcgagcattgccaattatgcggtcctttccggggcggccggtttaaccaaactctttggcgatgatgccccacgcatgattattttgctgaatgttgccatcaccatctgcggtattggtttggcgttgatagttaaagcacaggaaaaacggataccggccttgtcacaggcacgctaggaaggaagaacaaaaatggcgcaaaaagatgaaattgacggacacacggtgctagctggattgttagcccatccagctggtcattcattatcaccggcaatgtacaatgcgatgtttgaagccttgggattgaatgatgtttacttgtcatttgatgtggatgtcccggaactggggcatgctttgcaatcaatgcgtagtttgcactttttaggcggaaatttgtcgatgccccacaaacagcgggcgctaccattattagataagctctctcctgctgccaagctagtcggtgcggttaacacgattgtcaatgatcatggggtgttgattggtcatataacggatggcacgggattcatgcaggcgctgacaaatgatggaatcgatcttcggggtgacaagctgacactggctggagcaggtggggcgggaactgccattgcgattcaggcggcattagatggtgtccgtgaaatcgctatcttcaatcgccgagatgcttcgtggcaaaatgcccaacgcaacgtggcggtgatcaatgaccagacgtccgcccatgctcaactgtttgctctggataatcatgctgcattaaaagctgccattgctgacgcggcgatttatgttgatgcaacggcagcagggatgaagccactggaagacgtcagtaacatacctgatcccacatggctaaaccctgaaaagattgtctttgatacggtttacgtaccacgcgaaactaaattattacgcattgccaaaaaagcaggcgttaaacatgtttacaacggcatcagtatgttgattaatcaaggtgctgccgcgtttaatttgtggaccggcctgcagatgccagttgaaaccattcgtgaaactattttcggcgagtcagaggcacccttgaaaaatacggctactgcttaaaaagtgaccggtttgcacctgaatacaaagatgagaactgttgatcatttaaaggtcggcagcttttttatatccacctatcactcaccctaaaaggactaatctttccaaaagtttttacgaatgaattaagatgaaaggttgctatcgatcttacatttagttagtatatagttactgaaagggagggtattaaaatatggcaaaccttattggtaacaagcgatgttggcgctatcagctttatcaggatatcctcctgatgtgttcgtgcaggtgagacatcggcaagtaccttgcttaacggtgtctgcaggcaatcgtttcaaaattttgccggttcatgcgagtcaattggccgggttgggaggtgaaccttgacagaagcaccacttaaaatcgggattctcaacgtgatgcacgacaaagccgataccaaaacgcggctgcaacacgttttgagccacaccgatatcccggttgagttgcatttttactatcccatgacccattacgctggtcgggaagtaccggaagcggtgagctcgattctggagccgctggatattcacgaagcggcaacgatggacgggtttatcatcaccggctccccgattgaaacgctggaatttgatcaggttcactatatcgccgaggtgcggacgctgctaaagacattaggtcagcatgtgcccaaccaaatgtacctgtgctggggcgggatggtggcactgaattactttttcggcgtcagcaagttgattcttccgcacaagttattcggcgtttatccgcaaacaatgcttgaaccgcacccatttttaaagggtttgaaagaaggctttaagtccccacatgctcggtatgccgagatggatgtacgcgatattcgcaacgatccccgcttaacgatcaatgcgacaacaacgaaggggaaactcttcatggtgacggaaccgactgacacccaaacgtttatcttttcgcatattgaatatgaccggtggggcttggattcggaatacaagcgggaagtggccgcacaccctgagattagctataaacgggctaaacactattatcatcacaagaacgattatgaccatccgaagtttaattggaagaaaacgcagcgaacgatttttgacaattggattcgccacatcgcggatcatcgcaatgaaaaccgttcgccgattatttagggaggctttattatggtgacagcagcagataatattacaggtttaattggcaatacgccgctactcaagctcaatcgcgttgtacctgaaggcgccgcggatgtttatgttaagctggaattctttaatcccggtggttcagtcaaggaccggattgccttagcgatgattgaagacgctgaatataaaggcgtcttgaagccaggcggcaccattgttgagccaacgtccggcaacaccggtattggtctggcattggttgcggcggcaaaaggttaccacctcatcattaccatgccggaaacaatgagtgttgagcggcgagcattgatgcgtggctacggagccgaactcattttgacgccgggtgccgatggaatgccgggagcaattaaaaaagcagaagcattaagcaaggaaaatggttacttcttgccaatgcaatttcaaaaccccgccaatccagacgtccacgaacgcacgaccggacaagagatcattcgttcatttgatggtggcacgccggatgcttttgtagccggcgtcggcacaggcggaacacttaccggggttggtcgagctttgcgtaagatcaatccagatgtacaaatctatgcgctggaagcagcggagtcaccaatgctaaaagaaggccatggcggcaagcacaagattcaagggatctcagccggctttattccagatgtcttagatacgaacctctatcaagacatcattgaagtcaccagcgatcaagctatcgacatggctcgccacgtcagtcatgaagaaggcttcctaccaggcatttctgctggcgccaacattttcggtgcgattgaaatcgccaagaaactcggcaaaggcaagagtgtcgccaccgtagcaccggataatggtgagcggtatttgtcgacagatttgtttaagtttgatgattagtaaaactattagttataggtaagcaaaatagaagcggcgatcaattgggtcagttgatcgtcgctttttgtcttgagaaaatgagcggcagggaagattgcgtgcgtcaacattgaacaagattgttataatggaatctgtaagtctccatggtgcaatggatagcataatggtcctcgaaaccacagatccgagttcgaatctcggtggaggcattatttagcgtttattagcgtactttagaaatgaaaatgcctttatatcagtgttctcattgatttagctcaccttagaaagtgtcaggattacgttaagggggacaaaaaggggacacaacttgcaaacacgagatggagaaaccggactttgttaattctcggtttcggtaagattcgttatcttagcccatgtcaatattaacgcgcaaaggagttgtggtcagcatgcaaccagtcttactcgcaacggttcaccaccccaatgtgtctttgccgcagttaaaacaggttctggcagtagttagtgatagtttctcggctgcctatctgacggttagtacgattacagaccttaaagttaccaagttactgcagacttttcccagcgtccatgttcgcgtcattgaacctcgtggcgcggctgatgcgcggcggagggtacttgattttggattgcgtcaggttcgttaccacgcttcttttttttactgcgattttgataaagtggtgacagggatcgaggcaaatgtatctgagtttaagacctttattgcccagcttcgagttgatgatggctatcagattattgggcgaagttcagaaaacatgcggggttatccggcaacttggcgagaaaccgaggcaattacgaataaggcggcttctgaagtgtttgccttgcctgatctggatattactgctggctgttgtgcggtgagtcggatggctgccagatatatcttggctaattcgaatggtttgctgacggatacggaatggccgttaatctgtaaggcggcgggattaacgatcacagccaaacgcgttaactttttaccgtatgtgccggctttaaacgcaggtcgggatgacgataactggcacggttacacgagcaggttgcgacttgcattgcaggcgttgcaatcgcttgaaacagatgggacggctgatcttaaccaaccagtttcaattggatggccatataatgaagattagtatcgattgataagatatctaaacgaacgctaaaatgtgccctgtttatcactgttagcgtagcagtgatagacagagcacatttttacgtccgctgatgtatttggccagatccgactgcaagtgaactaactagatgtttctgttgagtatggttgaatgtgggcactcttcaaactttgaatggcttatgccaaattcgtttcaaaatatgtcaaagttgagaatgtcgttgttagttgattatgctatattctgcggaatggtaattaagaaagggcaacgcattatttcgtctttttgttggttgtaaagtatttagctatttttactgccagccaagcaatcagaaaaacagcgatgagacgaatgtaggttgctgatggtcccacccacgtgcttatcatataagcaatcggactgagaatgataatcgtacagaaaacgatcaaccagtatttcaaacttaatgactgagcctgtttcactttttcacctcgcgtctatttagcaaaagtaatagatattctttttgtattctttttgctgctatttttccgctgctgccagtgcctgctttagatcgtcaatcaagtcctgctgatcctccaagccaattgcaatccggacatgttgcggtgtcaaaccagaatcggcgcgtttgtcttccgggagcttaaaccaaggtagtttgaccagactggagatggtaccaagtgagtcggcaaagtcgaaaattttggtgctgttaacgaactttaagggatcaatgttgtcggctagtttgatcgttaagagtccgctggcacccgtggtttctttttgggctaatgcgtaaccgggatcggttttaagtccggggtagtaaacgtgggcaacgtctgggtgctgcgctagaaattcggcgacggcttgggcgtttgcagtttcacgatcaaggcgaacggagagggtggcaatgccgcgggtgacgaggctacagtcaagcgggcttaaaatggcaccgatcgtgttttgcaggaaagcgagcttctcgctgaggtcggggtgagcggagacaacgaggccggcaatgaggtcaccgtggccgccgaggtatttggtggcgctgtgtagaacaatgtcggcaccgaggtcaagtggccgctggtaataaggggttaagaacgtgttgtcgacaatcgttagcagatcatgggttttggcgagggcactgatggccttgacgctgctgactttgaggagcggattggaaaaagtctcaaagaaaattgctttagtttcggggcggatggcggcttccaccgctgccagatcacgcgtatccaccggtgtaaaggtcaggccgtgttgagaaaaatactggttaatgaggcgatcggtgccactgtagagcgaatcaccaataatgaagtgactgtggtcgggaaaaatcgcgagcaccgttgcaatcgctgcaacgccgctggaaaacgcaaagccggcatcaccattttctagcgtagcaatctgacgttccaagtattcgcgggtcgggttaccactgcgcgcatagtcccagtgggtttcctgaccatcaggagcaaagcggaacatggcactttggtatacaggtggcacgatagcaccggcttggtcgacatttagttgtggtccatgaacgagtttggtattgaattgggtcattgaaacccgacctcctttaatgaatagtgttcttttatgtatgcccgtcaatgaaacaggttgacgggcaatgtttgatggctgaatggcatgattacttggtggttaaatcggtgccaaaatatttttgcgacagttttttcaacgtgccgtctttgcgtagttcttgaatgccctttgaaagtgcggcttgtagtttaggcgattttttgctgaccatgccagctacttcatcgggtttaacgacactatctttgagggtttgactctttaagcccgcggttgagttatttttggcaaaggcataccatgcagccgaggcgttgatggttccgtctgcccgcttttctttcacaaggctaagcgatacggtaaagtcgccagacggggtgatcttagcgccgtattttttggctaaagcggcattgggtgtaccggtgccttcaacaaatgttttgcctttaatatcggcaagcgatttgatggtggtgttatcgctgcgggttattaaggcataacgcgagtacatgtacggagtggtgaagttgtagacctttttgcgtgcgggcgtttcactaatatcattcagtacgagatcaaatttctggctgcctaatcctgcaatcagcgaatcccattgggtgggcacgaattttgccttaaccccgattttcttggctaaggctttccccagttccacttcgaagccttcaagtttgccatctttgcgataagaaaatggcgcataagtaccttcaaggccgatggtaagctcatttttgttgatgagttcggcggtgacgtcactgttttttgacgtgtcagatgacgtgccggtgcaagcggtgagcgtgaaggttaccaaggccacaagcggcaacaggaaccacaactttttctttaacatagctttcttcctttcaaaatggcggattataattgcgtggtttgtgcattggcattgtagcgtgatgtgaatttttcgagataccgctgaccccaagctaagaaagtgcagacaatggcatacagaagcgcaacgattgagtacatcagtaatggttggtaattttccgccgcgatttgttggctgacttgaaacatttcgacaatggtgatcgaggcagcaagggatgtgtctttgatcaggctgatgaaactatttgacagtggcgggatggccgttcgtagtgcttgaggaataatgatttcgcgcagcaccagtcgccgcggcaatccaattgcataagccgcttcccattgcccggaatcaatcgacaacagcgaggcgcggatcgtttcggcacaatacgcccccgtgttaagcgagaatgttataattcccgcggccactggatctagcttgataccatgcgggaaaatacccgggatgatgaggctgggtaagccgaagaaaacgatgaataactgtaccagcaaaggcgttgagcgaaagagccaaacgtaaaaaacggcgattccttttgcgattcggatcaaaacacctttacgaaccgatatgcgcgtcaatgcggttacaagtgcgatgatcaggccgatcgcaaatgacacgagtgcaattggaatggtgtatttaatgccggctgctatcatttgcggaactgcatcggtaataattttccacataatgttcctcccaaaataacaatatatgcagatgttgatactcaagcgaattctttagtcgggcaacccgatatagcattttgacttcaaacttcattgaggccgaggagggaacaaaaaatccgcccttgcctatttaatagacaaggacggattctttccgcgttaccaccttgattagtcgaaatgctcgactcgctctaagtacgacacatcttgatgtgtgatactctaactcagtaacgggagtgcccgtcagttgcttgcggtcgccgtttgcaactgaatgctttaaaagaccatcttcaccagttcccgatcattgtctttcaccaaaatgacaactcgctgaggatcttcgcctgggtactcatcttttcgcttctaagatattgacatcacattaggctaaaaaacaactgttgtcaatagccggtgacaaatcgtaagctgtacaaggttgatatacgatgagaactgctttgacgagggcttaggcaaaaatgcgcttttctcattaaacgatgtacatcggtgacggctacccactagtcagttgacggatgatcatccaaaaaggcgaacttggcagatggttgatccaaactaaagcataaagccgtggcacatttttaggcctaaagtccagtgactttgtttgtaagatgcggtatattaatgtcggagtagttaaaagggatattaatattttagtgtttaagcggagggttaagatgaaaaaggcatgggcgttcggcttagctgccatgcttggcttgggtgtatcaacggtaatggctgatcaggcatcggcttttgctgcatcagcgccgccaacagcagcggacacaaccacacaaaagattgatactgaccaaaagaatacggacgatcaaacttgtgtacaagatgatatatcatcggaagctaatcaaacgccggtgattaccgtagcagagaccagcgaatcggttatcaatgacagctcggcatcaaattccggcagtcaacaagatgagcaggcatcggagagcagtcaagtgtctgagaattcctcagccacgagtagcagggatgcgaacgcaacaacagaagctgggtctaaaaagacagatgccaagagtgaagcatctagcagttcagtacctacaattaaaactgagcaggagagcaataaaggttccaaccaaccgaagacgaaacatactgctgaagaacaagctatggtggtagcagcgcaggcagcgacgcacgacaacattcatgtgaagatggatcagggggttcaggctgttacccagggaactgatgacttcacgatttctgataagccgcataatacattggagcgactgtggcaggcgttaatcgaatccgttgcacaccggcaacaatgcccaatcagctttgaaaatcggttgatcatgaccacgccgacgactaatcttgcctttataaaagattcattgacgccggttaagaagcacattaaggcaaccttttctgatgatatgctgaaacggatgcttcaaaatgattttttgaaaccgcttcagctaacgtttaaggacgttaccaagacgcttaaccaaataatgttagttcttgtcatcatgccagatagttcaacttcgcaagaataaagaagctttgaaggattatgatagcaggtaaaaggcaggtaccgaagacttagaagtgcagtcttcggtacctgcctttttatggatttagcgtttgtagacaatatccggtcatcagcttggaattaagctggcttttgggttgatcggatatcgtgtactagcttagttttgttcagcttcgagatgagttgctgcgactgctctgcgaactttgacggcatgtgcgacgaggccaaggacgagacccacaccagccggcacgagccagccgagacccattgcggaaaatggtagaaaatgaagctggaagctatgcagtgccaagcctaacgaactttgactgacaatggcgggaaaagctgcaaacatgtcgagcacagccggaacgacggtgaatgctacaacgattcggtaaaccagcggatcgtgatggaacgctttgccaaagaccgatagtaagatgagaaccattgagaaaggatataggaacatcagcattggaacggaccatgcaatgatttgttcaagtccgaagttggcggttaagaatgacagaaaacttgtcaatccaagccagacctgatagctgactttagggaaatgccggtggaagtcctgcgcgaatgccgcgaccaaacctaccgcggtggtcaaacaggtcagcgttagcaaggttgccaagacagcgtggccagcagtaccaaagtagaacgtaaccacctgattaaaagcagttcccccttcagcactaagcttaaagtgggccagagacatacttcctaagacgatcaaggcaacgtagattaacgcgatccaactcgtagccatgaccccagccttagccgttgctttggcgacatgatcatcgtttttcaagcctaaaccgcgaaccgccgttacgacagtcacaccaaaggctaaggcagcaagcgcgtccatggtattgtaaccctgcaggaagccgctcatgaaactgccgccatttttgtatgcggccgttaccgtttgggcagccggattccccattggatgtaagaaaccgatgaagaagacgaagaataacaatagtaagaagacgggatttaagactttaccaacagctgtggtgattttgcgttccttgtatgacaggaaaaaagcagccccaaagaataaagccgaaaagacaagcaagccgccttgttgccaggcttttggtaacatcggtaagacgccggtggtgaaggaaacagtggcagtccgcggcgtgccgaacattggcccgatcgtggcatgaatgagcaccatgaacgctaaggcgaaaaagcggccaagtggacggccaatatcatagacaccttcagcatgcgttgcggcgatggccaaaacgcctagtaatggtaatgcaacggcggtgaccaaaaatccgagcattgccgggaaccaattggccccagccagttgccctaaatgtaacgggaaaattaaattgccggcgccaaagaaaaggccaaacaaaagcgatgcaatgacgacataatcacgtgttttgagtttcttttcagataattccattgaactgcctccaataaaaatgttttaagttgcgtaacgtttaaagcgtttgtcatcggtttaatgtgactaatgtcagattccaattgcatcacttccttaattgagatacgtgaacggttcaagcttgttcccacaacggagatagacgaaaaaagccgcccttagcatttgctaagggcgactttgcgcggtaccaccttaattcaccatagccaaaaatggcctagtcttcatcgcatacggtcaaatgacgatatgctagcactgtaatgggtgcccccatgacacgttactgaaggttcggtgtcctgcttgaaagggatattcgctatgccctgaatgcttcctcacaccaaccgaagctcgctgaatccatgaacacaactacttgtctttcgcgttgcatttgtatttgattttcagtctagcatgatttggtttcatgtcaatcactaattgaaaattaattttgaaagcaaaattgaaaaaagggcaaaagttgtgaaatatcaaagattttgaagccttgggtgggtagaaatttttgggtgatcggaaaggcgcaggcaaaaagatttacagagtcctaactgctactcgggttaatttctgccgaaagtccaaatgagtcgttttaaaacagatgagtaaaaccgacttttcgattaaacgataacaagcgttagataatgcttaaaatagtatatttcgtttatttagtcgccgtgaagctttcttagggacgattatttgtaaaaaatgagtgatgggttaagaaatacaacgtgattgggaactgagttaacaagtaaacgtattctttgattgctcaaacaccatcatgttatatttaggtcagtaagatagatagtaaactataggcaaagcaatacggagggaataaagtaatgaagaaagttaattgtattgcagcgggtatttccgctttgacgcttgctggcatgatgctccctgttggacaggtttttgctgctgatcaaagcaagaagtcagtcgcagaaataaatgttgaagctggcgttttgacgcttgaaaaggttccggacttaaggtttgataaagtcagtatcgcagagttagcaggcgacacgggcgttaccaagaatctgattgataattcagtgtcagaccaaggccctgttaaaacgagtggcgctaatgctgctaatgctgatggcaataacaccggtgagctcactatcactgattatcgtggaagtggtctgggctgggagctgacagcacaggttggcgaaatgattaacggcgctggacagagcttagcaggaagcattgtgcttaaaggttcgacaccagttgtagatggaagtacgcctcagagtgtaagccctgatacagaagtaattttacctatcaatggtgcggcagtcacaatttggaaagctgcagctaaacagggacaagggaagaacacttcaacatttaaagctaacggtggtacgaagatagaactagcttccaacaagaccgctgttgctgggcgttaccaagctccaatcacttggaccttgtccgatgcacctaagtaattaagcaactatttctggggcagcggtcaatcgctgcccttttcataaccgtggggataagattatgagaaaaaaacttttactaggtctgctggcctgcttgagcttcctgtggtttggcacccatcagcaagtgcatgcagctgaaggcgcaggttttacaatcagccccgcattaccgcaaaatcagattgatcaatcaacgtacttcaatttactggtaaagccgggtaaaacccagcggctgctcatttatgttaaaaatacgacgaagacagctaagaaacttaaagtcagtccggtgagtgcgtttacgcaaaccaatggcacgattggctactaccccaatgatcacaaggatgatacggctgaatatacgttttcacaattagccggtgagcctaagaccattgatctagctggggatgctcaggtgccggtgacgtttgatgtcaagattccggcaaaaggctttaccggtcagatcctcggcagtttgtatgttgaagatccaacggtccataaaagcggcggcggagggatggcgattaacaacaaatttgccatgctcatcggggtggttttgcaaacttcaacgaccgaagtagcacccgatcttaatctcatggcggttaaaccagggtcacaggataatcgagccggggtgttggctactattcaaaacaccaagccacgtttatttggcgacatgacagtggacggtaaggtttatcgccaaggttcagataagccatatttaagccgaacggaaaagggctggtcatttgccccgaactcacattttgattacgcacttccttcaaaagaggcactttcgccgggcacgtatacgctagatttaacagtcaaagcggtcgataaaacctggcactggcgccgcaactttactattacgcgtcagcaatctgaagccattgagcagaagctgggaagggaagcaccgcaaaagccgtggttgtggattatcattgcggtcgtcctggcgttagtgattctcgtcttgctgtggctggtttggcggcagcgacgcaaagggagggagactgatgaaacaaaagaaaactaacttcttgatgatgctacttttgctggcactgttcatgatggcgggtaccgcaactcagagcgtgcatgccgaagtttctgtggctcaagttgaactcaccggagaaatgccagccctcaatcctgagcaacccgcagttcccgagcccgggaagccacatcaacctgaagataagggacagcagccaagacacttagcggccactgacaaacgtttaccgcaaaccggtgatgccgtgcaggtgtggtatgtcgtgattgggcttgaaattctaatcatcgttttattgtccgcactgctcatacacggccgttcacggcgaggaggtcaaaaatgaagaagaaaatattcatcataacctgccttgccgtgatgatcagcatggtgcttgggccgctgcagaccgtgatggcggaaacaccaaaatggccaagcccgggattaaacaacaaagtgaatgtttatcctataccgggagcggggacgttcactagcataaatggcgtttttgacaaaatcgaaggaagcaattcagctccgatcaatgttaataatgatacagtggcgctggaattgaatgctgataaggacgctcaggttggggcgatgtggagtaaaaaaccaatagtcgatttgactaataactttacgcttgacctgcaagtatattttggcaacaagattttaaatggtgcggatggacttgcatttgcactaacaggtaccagacctacgaacgcaggaattaacggggcttcgcttggggtttggggcggcgcagatgggagcagtgcagcgacgattgctgctcaaggacttcaaaacagttttgtcgttgttgttgacacacacaaaagtgagaatgatcccgatgcgctttatccaaatttgcttgagaatcaccagtatgttggctcaggttatcccggaaaaactgagatgtacggtattcaaaataataaatcaaagctcaaattcggggcggccctgatgccacctagttatgttaatcaaattaaaaacaacatttcgaatgacaaatggcatcgtttgtcaattagttggcaggcttatccagaaggcggaggggctttgacttacagttttagtaatacaagcagcacgccagcccaaacgattacgcaaaccgtcaaatggacggaaaccgaaatggacaatatctttggccagaaagtaagacaagtttaccttggttttacgagtgcatccggccctaaagtccttattgactcatatatggaaccgcatctcattaccatcaaaagcctagctgatttcaatcaaattaaaggcgccgtaacccttcagcgtgggacagagccagtagtagaggacacattgttaaaaatcggcgacaagctcacttatcgttacgtcattgatgttgctaatctggagggttcagaatggccagttaatcaaatcatattacccaaaggcaaatattttgactatctgaagccagatgggaaacctgccgttgcgggtgacaaattgccggtttcgattacggtaaatggccaaaccgttccggcagaagcaacggtgcaaagcgatggcaattcagcagtaatgaccgatctcgggacattgccaaaacgggctgatagcaaacttgaatttagtttgccagcggtggttaaacaacacacattgaccagcaatttgaaggttgataatgatcctacaggtagtgtcacaggtggtgcaaccacagcgaaaacctatacgtttgtcaatacggctgatcaaaaggacggtaagtttattaaatatgtcctcgcaggagaaccgggagctgtcactttgaagagtgttccgagctttgtttttaaaaaatttgtgaagaaaggcagcgaagatccaaccaacgtagatccgacagttgctgattttattcaaggctttccaggacaagagacttttccaacaacgatttcagaacttgatttgtccaagtggttaaacacgcttgattcagaggcaccttctcaaggagcaacaggtaaaattctcagcgtcactgacacaaggctgaataagccgggctggcatttgcaaatgagtttatcaccattcacattagaagatggcagttacgtcttaggcgacaacggcaacgcaaacgggggtaaagcagaaatggttatcgctgagaataaagatggtgaacaaaaggtgactgaaattgcacgggtaaaagacgatggaaacactgtcacggtaaaaaacatgcctcctggcggcagtgattggtcactcggaacagaggcaatgcaaacgcaagccttcatgtcgattcaaaagacgccatccgttcgcaccgggctgtatcgttcaacggtaacctggacattatcggctactcctatgccttaacaactgaaaatgacattgaaatgaacagataatgaggatatgatgtgtgtattctattgttgttgaaaactgtcatttgagttgaaaaggggttcagctatgaagaaaaattcaccgaagctagcacttctagtaatcagcattgtagcagcaacacttgctgtcgtctctcaagcacccattcacgttttaattgcgagtgttagtcacttcggttaaggcaccttatctcctggatcaaacgctgaagccgcggagaaacgcaatgcgctaattttaattaaagaccgtgtgattaagagttcaacctcttagaaactgtttgaggtctttgaaagacgcttgaatttccggtaaaatatgtgaaaaaaggacttcattatgactgattatccaagcaatatcactcgtgaccaatttgaattgattcgcgttgaccttgagacgtttcgcaagcgtacatgtcctcgaagggtggacctatttgatgtcttcaatgcagtgctttacgagcttcgtacgggcgctcaatggcgtcagttgccgcatgattttccgaaatggcaaaccgtttacacttactttgccatgtggtcaaaaccattagctaattcggaatattccctgattgacctgcttttaaaaaaattgtcgctcgagagcgattacgaatgggacgatcggtacgaacgtcgttcgtaattcttgatgcgcaaagcgtcaaaaatacggcaacaccccaaaataaagggtatgatggcggcaagaaaatcagtgggattaaacgccaccttgccgttgatattaatggtctcccattcgcgatccacattaccacagctaatgtctccgaacgggacggtgcgatcgctttactcgcgttaaatgaagagcagtttgatcttgttcagcgagtgatggccgatggtggctatacaggcgacaacttcgcccagtcggtccatgcaatcattggtgcagatgtcattatcgccaaacaaagtgatctgaagaacggtcaagtaacgccacagcgctgggtcgtggaacgtagtttcagttggttaaccaactggcgacggcttttgttcaattgcgaacgcaagttaaataccagtaaagtcatggttgctatggcctttatagggatcctgcttgctcgtcaatagagacctcaaacagcttcttagttgcacggtcctttttgattacgggaaatataagattgattcaatgtcacggcagcggcagtattttgaaaatgtcagtttttcgtgaatggaggaaagtcaaaatacggcacttttagttggtataaatataattgtgcaaaaatgaaagcaagaatataatcgttgaaaattattaaataaatgcttttaatcaaataatatcaattttttggaatctatgttttggtaaatgatattttaaagatttgaaataattaataatattgttattgactttataaggaagaaaaaaccaaattatttaaattttacatcaagaacataaaaccagacgcacataagcaatataatgctgacgattcaagaatataaattctataaataacgtttaattactaaaatataacaataacaattgtaatgtttgaagaaagcgcttgcatttggattaattcgagaatactataatagacgtagagaagaaaaacaaatcaaataagaatatggaggataatttaatgaaaagagttaactacatggcgatgggtcttacagcattatcgctggctggtatgatcttaccagtcaccaatgtattggctgcaggcgaggctgacacgccatcaaagaagacttccgttggtgaagttcgggtcggggtggatccgactaatccagacccgaaaaacccagacaatccagatggttcgaaggatattttatcattggtaaaagttccggatctgaagtttaagagcgtcagtgttgaagccttgtctaccggcgatcaaactttgccgttactaaataatacggtaactgacaaaccagtgaagaatgaacctgctgggaatgcggcagatggtaataatcagggaatcttgaacattacagactatcgcggaactggtgcaggttggcgattggaagctcaggcaggcgaacttaagaatgaaacgggtcaaaccctgggcggcagcattgtattggcgggtgatatcaaagcggacgaaaccgataataatccggcagcgctcgcaacaaatcctgaattagttctggcaggtagctcggttccaatctggcaagcggctaaagatcaaggacaaggcagaaacacctcattgttcacctccccgcagaacctactgaaactgaccaaaaatgttaaggcctatgcaggtaagtatcaaactgcgattacctggaccctgacaaatgcgccgggtaactgattatcaaacgtcagaagagggacagtgatcttcgactggccctcttttgccaagtttaacgctgaatgattggttctttagccaagttttgcttgaaaaaggaggtgctaaccgatgggatttagtacgtggcgtttttggatcaagctggttgttttaatgggcttcattggcttgagtagtgttgccgtctatgaggtacaagcagcaacttccatcggcgaggtgatcgtgatagatgatcgaccacaacccgctaatcccattaatgcgcctggcagcgacattttaacacccaagccactgaaaaataatttaccgcgaccacctaaatcgacgccgcttcgcctaccgcaaactggtgaacacagtcagcagggtatgttaccggtgattggcacgatgctgttactcatcaacagcatgggcctgagcttctggcgcgggcgaaaagacaagggggatgaaaatgaaaaagcaaatccttagtcttaccaccttgttaatagcagctggaatctcaacagcctatccggtagctgcggcagatgacttagggccaaaatcatccgtggctcaattgacagttgatccaggcaatatcgttttacagcaagttcctgacttaaattttggcggcatttccgtttatgaaattgttagcggacagttcacaaaacatgcgttacgcagcaataaggttaatcaggggccggttaaaaatagtacgaatgctaatgacggtaacgcgtctgggttgttgcaggtgggtgattatcgtggcaccagcgcaggatggacgttaacagcaaagatggacgcgctaacggatggtaagggacattttttggaaggttatattgatctggtggggacgaatccgacgacgagtaatcctgatttgaatgccgttcacccagcaggggcccaagcgccgcggttgaagtttgccaaagatcaacaaacgcctgagacggtggtttggcaggcagatgctgcaagcgcgactagtaccgggcaagggcagggtaataatcaggtgactattagcgctggtacggagttgacgttggtttcaagcccgatcaatgtcaccactcaaataggcaggtatcaggcggcaattacttggacgcttgccaatgcgccgcaaccttaaaccacatcaatgcgttcaccagtgcagaagcctgcgtgtaaggaccttggctgcgatggtcaaagtgcgaccatcacgcccaaggccacttacactccggcttctaaccgcgctggttcacgctcaccataacgcgttcatcggtgcagaagtctgcatgtaaggaccttagacgcgatggccaagagcgggccatcacgtctaaggccacttacactccgacttctaaccgcaccggttcacgctcaccataacgcgttcgccagcgcagaagcctgcgtgtaaggaccttggtcgcaatggtcaaagtacgaccatcacgcccaaggccacttacactccggcttctaaccgcgctggctcacgctcactttagaaaggagtgatgatcatgaagaagtgcggctacctggttacttggttgggcttgctggttagttttttgatggtggccccttccgtgtcggcgcacgccgcggctgggtggccgtcatcgtcagggtaccccgcaccgccatcattttctgatgttaccgggctctttgaaccaactcaaaaagattcaagtttgattatcgattctgcgacgggcagtgcggtcggaatggaaattaataaagatgctcctaaccaatccggtgccatctggagtacggcgcctatgtttgacttggacaaagatgcgtcatacaccatgtattattatctgggtaataaaaccacaattggtgaagggatggcgtttgtgctggcagctaaaccagcggcaccaaaacaaattgacccatcatcgcttggtatctggggtgtcgatcatttacctgcaggcagcacctcccagcaaatagctaatacagcattaccaaatagttttgccttatatgttgatactcggcgtaatggtggtgatgctgcaggtggttatgatcaatatagtgcttataccgattactattttggcgcgggctatccaggacaagccaatatgtatcgaatttctaatccttattggatgtcgtggctatattttaaaggcgatcctccttttaatggcgtccaaaccggaattggccgacagaatacccttgcatcaacggcggcaaacggtaaatggcatcaagtgaaaatagactggaagaaggataaccggggaggcggcacgctaacttatactgtcacggttcagaaaagcaatggcaaaccctatgtattttcagagaaagtcacttggacaagtgctgatattcaaaactactttgcccaaaatgcaggcgatccggttccgcggcgactctatttaggcttcacggggactaccagtaattactatgaaccacatgtggttgctatcggtgctttaccggaagtggcgaaggttaagggaacggttgcgttaatgcgaggcgcggaaacagttgatgccaacacgcatttgaaggtagaagatgccattcattatgattatgtggtggacgtccaagcaactaagcaagcagcatggcctaccaatggcaccatcaccatggatgtacccaaaggacagtattttgattatctcaaagcagatggaacgccggcgcaaccagacgaccagcttccgataacgcttacgattggcagtcgcacggttaccgttcaaggaaaagtgcaaagcgacggcaatcggattgtcgttacgcaaatgccgtcagttgcggccggaaccgcagccaaattgcaattttcgctaccggcgcgggtaaagcatcacgccttgctgaaatcgacgctgtttcatgataaaccaatcggaacggtcagtggcgacgggcaaacttatgatttaaaaacgcctaccggtaaagatgtgttggagtatatccttgatccggaaaccggtgatttaaccctggaaaaagtgccgagttttatttttgaactcaaagatggcgcgggtggttatcgcaatccgaacgtcatggacatggtgaacggtattcctaatcccgatacggcatccccgaatcagttagaaacaggccagtggttgaccaatcagcatggactggagtcagccaactcgacagggaaagtgttaagcatcaaggatacccgaccgaccaagcaaggctggcatttgatgatgcaactgacgccgtttacacttgtcgggcagccgtatgttttaggtgatcatggtagtcagcaaggtggcaaagcaacgctggtcttggcggatcgaaccgccaccggaacggacaaagtggctacaatcagagataacaacaatgcaaccttggtgaagaatatggcagcaggcggtactgattggacattaggcgcacaaaccggcaatattgcggcttatctaggcattgaacaaactgctactgctaaagccggacaatatcacgccactgcaacctggttattaagcaacgctcctcagtgagtcgggtaagcagcgctgattataaaaaaggatcctgatcgtcagtggtaaatcactgcagatcaggattcttttatatccgatatcaagttgctttttggatacggctaaacacttttctttcgcgaaaactgccgaattaagcggcgttgcacatgttgcaacttattaaacggcagggcttgcaacaaggtgtttaacacgataagaaaaccacccagccactctgccggaccaaacgcaatgtgcaagcgggtgactgctagtgtggtggctgtcaatggctcaaacgcgctgagcatgcccgttgcgactggtgaaatgtaatgcaggctgcctaagacgagcaagtaagcaagcatagtgccgaaaattacgacaaaggcaatggcaccaagattaggcaatgtcagcacagggttgcggcggagtacatactggggtaaaaagggcaaacttccgagcagcatggaccagccggtgactgcccgcgcgtcatatttggcaagcaaagtgcgaggcagcagcgtgtacaacgcttgactcacgccggccataattccccagaagactgcagccggtgctagactcagactggtgagccgtccgcgcgttaccaacaaataagtgccgatcagcgcgagggtaatactcacgaaatcaatgcgccgcggcatttggcgggtagcaaatgcaacatagagcaagataaaaaccggccccaggaattgcaggatcgtggctgtggctgcatttccggcactaatggcgagaaaataagtcagttgggaaggcaccatacccagaaaggcgaagagaattagcaacatggcatcatgccgatttttccaaatagtgcccaattgccgtaagtctttgagcgagctccagataaccagcaataatccggcaaaaaataaccggataccgactagccataacggttgcaccccggcatcggtaaataacatttgggtgaatataccgctagcaccccaaaagatggcgccaacaacagcaaaaatgacgccttttagtttctgatcattttggttcacgaggtgggtttcagtgcgcgacatggcgggtttcctttccaaaataaactatccagaccattctacgcaaaaagctgctacttggctagttcgtgccttgttgatgacggcgtcaactttttgtgggtttaacttgtaaactttttgctagaatgctttttcaacttacaactgatgtgtgataccgtattgccagccgcgatgtttcccactagcgagttctacaaacgctgcttgcgccgcttgtgagtatttcgtggctgctgatttaaactgaatcttaatacgatcatcaacgcgaatatcaatctttgtttggtgacgttccttggcttcggcttctaaccgctcaaaaacgtttccgcccttaagcacgtatacccgcgtctgtgataaattgtctgtgccagtttgtgaccagcccattggccgcgaactgaagcgctctgaaagcatatgactaatatgaccttcagctgatgtcccgtgaaagtctggatcattgttggcctgaatttgtttccaattcttgtgaatgagcgttcgtgcttgtcggacagctttgcgttctgacgaccgtaactgagggtcattgagccgaacacggaaataatcatttagatagcttgagtgcccttgtaacgcccaatgcatgagaatatcgcccagattaccgggtacgccaattgccgcttgtttgcacgctttacgtaggtgaaatttatcgtagaccaccgtgcagttgggtagaaaatcggccccggttttgatccaactggcaccatcaccggccagaaaaaagcgtttgggcatctgaccgccatattgtttcatgatgcaatcaagcgtggtttgccagatttcttcagtaccagctgttcccgggtattcaccggtaatataaaatggcctaatcaactgaaacttcttacccacagaccgataaccttcatgtacataaaccattttcaagaaatgattggtgccgtcctgatgggggacatgatcttcatcggcttcgacaaataatgtttccggtacgggcattggttgatcctttaactgatccaaagcgctgatggccttcccgtctctatgaacaacatgcatgacggtgctcttcgatggttttgtacccccgccgttacgatctcctgattgcttgtaagacatttgggcggcatcttccagcagcttagctttgaggtcgagcgaaagtcggctacgcttctcaataccaacgagttcatcaagcaagaagacacgctcgccagtccgtttatcttgataataacgtcgggtgaaaaccagtgagccaatggatgccaagtaagtgcgttcccgcttatctttgacgctatagaatcgacggcggtaagcactgtccataatagcttggtccacttgttccagtgcctgcccaactaactggcagaggtgctcacgaaagttttcctgattggttaaaatgaattgacttaaatccagcttgcccgcgaccatctccatgacagattcatcaatttctttcaacatttctaaaatgatttgttgtactataggtgacaagagcgaattcctcctactgctatcgtgtttttcttgcaattaacattctagcacgaagggattcgctccctttttgtttgctcagatatcacccacttaaactttacgccatgcttgttgatcaaactttcgaataagccaacctttaaatcaagccattaaaaaacctcgcaaacacgtcaagcgcatttgcgaggcaggttcgttagtcattttcagtattaattctgagctcatagcgtaagttggtccgatagaaatggccgaggagtgccccgatagaagcgcctaaaataatgaggcatagcgggaagagccagctggccagaaagccgccgatgaaaatgacggccattgccgcaatcaggccaatggcgatgctgacacacccaaccgcaccaccgctaaagttagcgttggcagaatagacactggcaaatggaaattggccgccaaccagtggccagcccatcatgagcgtgaagccataagtcaacacgatcacactaatgccggccaacaaggataaccaaccacccatgatggttgtgaccaaggtgattagcaacagtggcggcaggaagagtcgggcgaacatggctttaaccacgccgcgtagtaataagccgtgggttgtgaacggaacgtattggaaaaccgccatcgcttttggctgacttgagaagcgtaagttaaccagcgcaggagctaatgccacgatcacgcccataccggcataagcaatatagtgctgggcagttgcaaacggcatatcgcgaatctcggtactgataaaaatcagcggcagaataatgccatacgccagctgcgggtaaacgcgtaacttgtaatcacgttcgctaccaagcacccgccagcctagtgtgaaataagttcgctcatccccgggccgggtcattaaagtactaatgccgcggaaccaccaaccaagtttccgggtacgtgaatcgccttgattcaatttttccagataggactcgaacgcgccagaataatgtaagaagacgagtgtgagaacgccgggaacgacgatacttaaaatggttaatacgatacttaataaattcacttggtcagcaaaaagcatcggcagtccggcaaaccatgctggcactgctagcaagtatacccagctgaattcaggaacaagtgacaggttgactgacgacattccgcgcggtagtaaattaggtaattggcctccgacgtaaatcccgatcatcaagagaatctggactaagttgagcatgttgcgtaatcgctcgccatcgaaatagcgtaacaccagtaagtaaacaaataaggcgatcactaaactgaggataccgcttagtattagcgccaacagcccacccacggctactagtggtccaaagtgaagaccagtgacgacaattccgggaatccccattgctaataaggtgatgcccagatagaagcaaacattaaggatgcgcgcaaaactcaaagtgcgatcattgaccccgcgtgaggcaaaaacggttcgatcacgcggatcaagaattaaactcgaataagtggttaggatgttcagaaaacttgttagcagttgaacggagaaaaagattgtgaacaatgtcaaagccgaggccggtagaaacatcatcaggccaataatgaccccgaaaagcagattccagagaaaaccggttctcaggctggcatccttaccgcgcttacgctgactgaaaagactgcccatgccacttggttcgcgagcggccagtaaatttttggtggccaaaatgagccgcaactgatcaaattggacaccgcgtttttccagcgccggggcaaagcgatttagccaggcaaacactttgggtaatggcatggcggctgtgttgaccggttcggcttgcgttttattcagccgtttcattagaatcaccgcctgtcacaatatccacaaaggtctgggctttttgaccatgctcggcaaaaccggtcagatcgttaaacagctgttgcaggttggtatccgcttctttagcaagggtcttaaacggtccatctgcaaccaccaccccgtcattaagcaagatgatgcgatcggacaatttttggacaacatcgagaatatggctggaataaaaaattgtcttgccgcggtcgcgcaggttttgtaaaacttcttcgatgacgagcaccgtattggcatccagaccattaagcggttcatcccaaaaaagaatatccggatcatgcaatagactggcaatgatcagcaccaattgacgcatccctttagaataagaggaaattcgccgatcgaatgcatctttcaagttaaccagttctgctaaggcaaatgctttttgctcggcatcggcagcattgagaccatacagttgcccgatcaggctaagatattcacgggcagtgagcgcatcgaaaacatcggcactttccgggacatagccaatgcggcgtttgtaggccgtcgcattaggcttgagtggttgaccgaacaattcaatcgtaccggcatcaggctgcagcaagcctagcatcattttaacggtggtacttttgccggcgccattaggaccaatgtaaccgacaatgttgccgggggtaatcgagaagctgagatccttgagaacctgtttagcgccaaaactttttacgatatgattcaatgaaacaatgggttctgccatcataatggcctcctttagtcgggcgttgttatgtatgtatgtcatcggcgttagtcaatgatgtgatcgaaaatggtacggcaatgcttgcgctgattatgacagaaaaaattatgcttgtataggcaaacgacttatttataacgtatttttcgggtataaaaagaacaccgctcagattcagcagtgttagataaacgcttagacttctggactagtccacaataaaggctgattaaagaacataaacgagcttaactattaaaccgtttgaatagtggacgaagcataaagtacaggataggaacgataatcgctgtggcaatggaattgatgaccgttgcgggaagacttaaaaaggcgccaacaaccgcggtttttaagatggttccgaccatgagtgcttcgacgataccggttaagtaagaagtgacgattttggttagcccggcaacaatggcaatggtgataatatactgcggcttgtcctgatgcttgaaagccttaaccaacgcactgacaacaatggccatgacgattgcttccaaggcagttagccatgaggtggcagcataaccattaagcaaatcaaaaccaccaaggccaaccacagccgcaaatccgccaagccgcccaccaagaaataaaattgcgagcaccatgagcggattgccaaagtgaataaacggccgcccgaccatcgcagggatgggaatacgcaaaagggagatgccgatgtaaatagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacgctgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaaataatggcagcaaataagccggtaaagataatgtttttcaaggaatgtcgtgaaacttgcatgggaaaacctccaaaaaaagtgagcgcgagccggcgcgggagaaaccggagtgtaagtggcctcaggcgtgatggccggtctttggccattgcgaccaaggtccttatacgcagattcctgcgccggggagtgcgttatagaaagcaaaaagtgtgccaacgcgttcaggaaacggaacataggagcataacggctagggcacttattaaatgcagactcctggcctaggcagcgcgttatggtgggatctagtttataaaaaataatgccacaatagccgaaatctctacggcagttctttactaatagccgaaacgaccccagttaaattcaagccatatttgggattggtattcgtagccaaagtggctttaatggcaatccgcgcggcaatcatggcgatcgctgcagcttgacgtaaagtttgtccttttagcaaggcacttgccaaagcagcggcgaaaagatcgcctgtgccgaaataatgcccgggttcttttggctgagcgagtgcaagtgagccgccttgtgcatccaccccgataacggccacttggttatggtatggcacgccggtgattacgacggcactgttgaattgggtgtaaagacgtctggccaaggcgctcaccgttttaggatcggtaggtgcggttaaaggttcatccagcagtagttgtgcttcggtcacatttggggttaaaacagtggctcgctgcgctaattgctgcatggtagcaacatactgtgaatcaaagcctttataacgtttgccatcatcgcccatcaccggatcgatgaggacgaggtgagattgaaacttgggcagccaacgttcccattgatcagcagcgccttggcccaagtagccgaggtagatcccgtcaggatttagttgcagctgttgccaatgtttgagaataccgggcatttccgaactaagatccagataggtattcgcgccgagtccgccagtgtggctggaaagcaaggcagtgggtaagacatacggcgttaaacccaagccggccacaagtggcaaggcaacccccatcgaaacctgaccgacaccgcaaagatcctgactgataacgatacttttagtcgacaaatgaatctcctttctttttaactagttgttaactttgagaatggcgaaattatggcaatttgtcaaatgaaatttaatcattctttctggtctcacatcagcattcggctaactggagaatggcaaggtttggtcaaaaatcatttggactgtgcatcgatcctgagtcattttgaaatgaaggttgtttaaacgttttcccgcttgcgcacaaaacccgttttctttgcgtggatttagctgaccacggcaaagaaaacgggttgcagagtgtgtgctcttggaagattaagcattacggatggtctgagtagcggttgcaatgcgtttaacgacggtcgggttgtccatcgtgtaaatgtgaataccatcgacgccatggaccagcagatcaatgatttgatcgatggcataggcgataccggcatcccgcatcgcttccttgttaccggaaaaatgctgcatcatggcgacgaacttcgggggtaagtgaacacccgccattgttgccatgcgctcaatttggtgttcattaatcaccggcataatcccggcttcaatggggacattaatgccggctaatgctgcccgctcacggaattgatagaaaacctgattatcgaagaaaagctgactaatcaattgactcgctccggcatcgactttttcctttagatggcgaatgtcgctcacaacgtctggtgactcgggatgcttttccgggtaacaggcgccgacaacgtcaaagtcgccaacttggtgaatgtgttcgattaaattgcaggcataagggaagtcttcactgacgcgtccggacttggggatgtcgccgcgtaaagccaagatgttgtcaatgccggcttcctgaaacccacgcagctcagcatcgacttgggcgcgggtgagttgggcagcaggaagatgggcaacgggttcaagattgaattcattcttgatcaacttagccacttccaaggttcccatgtgcggtttgttgccactagcaccaaatgtgacggaaacaaagtccggatcggcggctttaaccgcgtccagagtgttgaggatggggcgcatggcgatgttcgtcgcatttttacgcgggggaaacacttcaaatgagatgacttgatgatctttaaagcactggctgattttcatgagtaagttccttacgcacttgtttagcagcggctaccatgttgatgaggctggccttggtttcagggacatcgcgagtcttgaggccgcaatctggattgatccaaacgtggtcagcaggcagccgcttgagaatttcgtggataatatgcacaatttcgtctttagacgggattcgtggagagtggatgtcgtaaacgccagggccaacatgagtctggaagtgggtggcttttagaatatccaaaaggctaaagtcggagcgggccgcttcaaaggagattacatcggcatcgagatcatcgattgctttaatgatgtcgccaaattgcgaatagcacatatgggtgtgaatctgggtttccggttttactttgctggcaaccagccggaatgccggaactgcccagtccagatatttcggataccagtcttttttgcgcagcggtaagttttcgcgtaaagccggttcgtcaatctggatgattttaatgccatgtttttcaagatcaagcacttcatcttccaaggctaaggcgatttgttctacactggttttttgacttaaatcttcacgcgggaaggaccagttgtaaatggtgactgggcccgtgagcatgcccttgacgagatgatcggtttgactttgggcaaagacggtttcggcaacggtaatcggtttggtgcggacgacatcgccccagataatcggtggtttaacgcccctggtgccatagctttgaacccaaccattatcggtaaagcggaacccgccaaagttttcgccaaaatattccaccatgtcgttgcgttcgaattcaccgtgcacgagaacatccaggccaatttcttcttggaatctgagccattcgatttcttctttgtggttgaaggcggtgtattcgtcttcggtaatttcgtggcggcggaacttggcccgattgcgccgaacttcagctgtttgggggaatgagccgatggtggtcgttggcagcagcgggagtttgaattcttttgcttggatagcaagtcgggttttgcgctcaggcgtgcgtttgtaatcttccggcgtcaaagcggcaatcttggcattcaaggctttattttcctgataacgcggtttactgaaaagggcaacgttggcttgataagcagcatgatccgcgccggtgtggaaaatggcatctaactcatgcaattcgttgagtttttcttcggcaaaggccaaatattgcttttcttcaggtttcagatgggcttcattgcgaagtgtatatgggacatgcaagagtgaggtcgaggtgcttaataccagcttgtccgtaatagttgccaattgtttgatcgttgccaaggcatcggcataatgtgtccgccaaatattcttaccattcacgattccggcaaataaggtggcgtgcgctgggaagccgtattgtttgagcagatcaagattggcatatccttcgacaaaatccaagccgaagccgtcaaatggcagtttctgaatacggtcaaacgaatcggttaaatcgccaaagtaagtctgaaccaggattttggcagcctttttttgggccaaaatcggggtataaagccgctcgaataaggcgaggtcggcatcggtttgatcataaaccagcgccggttcgtcaagttgtacccagtcagctccagcttgatgcaagcgatcgatgatggtcgtgtacgcagaaatcaggtcggctacaaagtcatcaggcacaacatcaatgaagcgagacaatttcagtaacgtatacggtccaatcaaagtcgggcgcccgttaatgcctagcgctttagcttcttcaaattgcgcgaaaagctgccaatccgttacttggatcttggtatcgtgatcgaattcaggtaccaagtaatgatagttagtgttgaaccactttttcatcgccaacgctttaacatcgccggcctctccttgatagccacgcgcttgggcaaagtaggtgtcaagcggtgataagttcaggtcttggtagcgcttgggtacaatgtttaaaagatttgcaacgtccaaagtgttatcgaaaaatgaaaagtcaccggttggaatctgatcaattccagcagcttgaatggtttcccagtgagctttccgcagtgcttgagctttttcctgcaagtcttgggcagaaatttgatgcttgaaatatttttgggttgcaaatttcaattcgcgatgttcgccaatgcgtgggtagccgataatcgttgttgtcataaaaatcctcccaggtaaatgagcgtgagccggtttctgcaccggtgaacgcgttaaaagtcagtgctgtggaaacgaatactgatcagctgtgcaaattagccaaccatgtcagcttttatcaaaaaccttgccaaaagatgcggtcacttaggcgtacggcacatttgaaaacaaaaaagccgtccttagcccagacatagcttgtctgggccaaggacggcttaccgtggtaccaccttggtttgaaagctgctcacacaactttcctcaatcagtccgacagtattcactgtgagacctaacgcaataatgggcgtccccatgtgtgctttgccattgctcggcacacctgcatcaccaagaccatattcgctggcatttttagatgtcctttcaccaaaatggacactctctaaacaaaaaatgaacagctactcatctttccgcatttcaatgttgcgactagcatactgacaattgtggtggttgtcaagttgtttattagttatgtaagtgtcaacttttcttggttctactctaattaagtgatttccgatactccgagctggctccgcggtggtggaggctggcgaccgcgcagctagagcggtgggcacgactttgaacccgcaaaatgcgcggtttcaaagctcggccttggtctaaagcggagaagatcactccgcttaagaccaatttcacagctgagcccatcgccgctccgccagctcttgctttctatcgtactattcgaacatggtgaccactcacattgctgttggaagttcttaattgatactcaaattgataactatataaccgggcatttaccctgacttgtcttccattttgcggtaagctattaggacaagtcatcggaggaaaaagaaatgaaggtactatttccatatatcaaaaaatatcgttgggacgcgatctggtcggttgtcgcgatttttgtcgtggcttttgcgacgctttggcagccgcatttgttgcagattatcatgaatgccattatgaaaaatgataagcaaacggtctgggtcaatggcctgtatttgattgggctagccattgtcggcattgttggcgggattgtcaacacgatctattcggcacgtgtggcgttaggtgtggcgacggatttacgcgcagacgagtatgccaaaattcaaagtctggcttatgcggatgtggagaagttttcaccgtccaatctggttgtgcgcatgaccaatgatatcaatcaggttcagcagattatcatgggctttttccagcaggttacccggattccgattctctttattggggcggttattcttgcgattgtcactttgccgcaattgtggtgggtgattgccgtgatgatggtgctgttgtttggcgtcagcttcttttcatttagtcatatgggcaaatactttggccgtatgcagcaattaattgagcgggtcaataccttggcgcgggaaaacttaatgggcatgcgggtggttaagtcatttgtgcaaggggctaaccagacgaaaacatttgccgaatcaagtgacgaaatgcgcgatgtcagtgttaagatcggtaatctgtttgcattattgatgccagccttctttctggttgccaatttagccatggcgttgagtatctggcttattggccaaaatattaccagtcagccgagcaatttagcggccattaccagttttatcaactacctgatgcagattttgtttgccattatcaacggcggatttatgctgacgtttgcatcgcgggcgctggtttctttgcggcgaattcatgaggttatggatactaagccaagtatgacgtttgtcgatggaccgcagcgcgatttagacggatccgttgagtttgacgatgtgacttttacgtatccaggtgatgaaaagccgacgattcgagatatcgattttgcggttaagccaggggaaatgattggcatcgtcggggcgaccggtagcggtaaaacgaccttggcacagctgattccgcggttgtttgatccggataccggaatcgttaaagtcggcgggcatgatgttcgtgccgtcactgaaacggatttgcgcaagacggtcgggtatgtgttgcaacgctcgacgcttttttccggcacgattgccgaaaatctgcagcaaggcaatcctaatgctgacttggcagcgatgaagtgggcggctcgggtggcgcagtcggctgaatttatcgaacggctgccgcagacatacaacgcggaagttgaagaacggtcgtcgaatttttccggtggccagaagcaacgcctttcgattacgcgcggggtgatcggtcatccgaagattttgattttggacgatgcaacatcggctctggacgcgcggtcggagaaattggttcaagaggccttggcgcatgaattgaagcatacaacgacgattattattgctgaaaaaatcagttccattattaaagccgatcgtattctggtgcttgatgacgggcgtttggttggtagtggcacccatcacgaactggtgcagcataatcgggtttatcgagaaatttatgccacccagaaggcattggaagagggggtgtagctcatgaaagacttgaaaaacgcaggtaaattttacgcgcattatttgcgaccgtattggttagaatttttgattacgacgattttaatcgcgatttctacttgggcgattgttgtcgcgccgacatatatggggcgggcgattgaagaactgaccgtttatgtgcaacagtggatgaatccggcgactcgcgcccaggcatcgtttgcggcgtttaaccacacgttggctattttcgtcttactgtatgtgattgatgcgacctctatcttaatttcgagcttactgttgtcaaaaatcagcggttattccactggaacgatgcgggttggattgtttcggaaaatgcaacggatgaaagtgcgctattttgacagtcatagtgatggcgacattctctcgcggtttacgagtgacttggacaatattttcaatgcgatgaatcaggcgttgattgaaatctttctaagtggcgctcagtttatcgggattatctggatgatgtttacgcagaacgcgacccttgcgtggatcacgatggcctcaacgccggtcgcaatcgggttatctgcctacgtgatgcatcaggcgagtgtgtcggttgatcgccaacaagacgatattggccgactgaatggctatatcaacgaacaaattaccggccagaaaatgctgattacgaatgggttgcagcaagaaagtgtggcgggcttccaaccttataacgcggcggtgcgcaagtcgaatttacgcggccagatctggagcggcattttgaatccgttgttgatgggtttgtcgttgctgaatacggcgattgtgattttcgccggatcttggctggcgctgaatggctccttgagtcaaggggctgcgttggcaatggttgtggtgtttgtcaattatgcccagcaatattatcagccaattgtccagttgaccagcttattcaatatgatccagttggccatcaccggcgcgcggcgaattaccgaagttcgcgaacagccggatgaagtcgatcccaaaaatggccgcacccttgatggtctgaaacatgaactgctgattgataacgtgcattttagttacattccgggcaaagaaatcctgcacggggtcacgatcaaagtcgaaaaaggcgagatggtggcgttagtcggtccgactggcagtgggaaaacgacggttatgaatttgttgaatcggttctacgatgtggattctggcgcgattacttttgatggcgtggatgtacgcaattttaaattggcatcactgcggcaaaatgtcgggattgtgttgcaggatccgcagctgttttccgggactattcgcgataatattcgcttcggtgatccgactgctgatcaagcccgggtagaagcagccgccaagcaagcgaatattcatgacttcattatgagtttgccagatggttatgatacgtttgtgtcggatgagcaaagtgtcttttctgccgggcaaaagcaacttatgtcgattgcgcggactattttgactgatccgcggctattaattcttgatgaggctaccagcaatgttgacacggtgaccgaggctaagatccaagcggcgatggataatgtgattcagggtcgaacaagttttgttattgcccatcgactgaagacgattctaaatgcagacaaaatcgtcgtgttgcgggacggccgaattattgaggaaggcgatcatgaacaattgttagcacaaaatggcttttatgccgagttatatcacaatcagatggtctttgaatagcagctttaagactccgaacttttttggagtcttttttattatcattcgtatatgaaacggttacggtggctatcttaaattcaaatcttatgatacgcttgttatatcagaacaatggtcggcattgaactgataaaaaagcatcgtggaggtaaccaatgagcaagcgtagatatttagtggcacttggcggtattttgttgcatttgatgatcggctcggtatatgcgtggagtgttttcaccggtccaattgctaaacaaacgggctgggcattatcagcagttacgattgcgtttagcattgccatcttttttctaggtatgagcgcggcgttcatgggccgactggttgagcgctttggaccacggttgacgggcactgtggcagcgctcttgtatggctcggggattttgctaaccggtttagccgttcagattcactcgttaccgttgctttatatcggttatggtgtgattggcggtctgggcttaggtgccggttatgtgacgccggtttcaacgattattgcctggtttccggataagcgcggattggcaaccggcatggcgattatgggctttggatttgcggcgatgctgacgggtccagttgcccagcagctgattgcaaatctgggtgttgtcgcaacaatgtatgttttaggcgcggtttatatggtaattatgctgggatctgcacaggtaatccgcaagccgcatcctcatgaagtaccggcagccgatcttgccaaaagtgtgagtctgaccggaaaagctatgacggcgaacgaagcggtcaaaacccgatcttttcggtatctgtggctgatgttttttattaacatcacctgtggcattggcttagtggcggtcgcatcacccatggctcagcagcaaaccgggatgtcggcaaccacagcggcagtgatggtcggtgttgtcggcttatttaacggtttcggccggctcgcatgggctacgttgtctgatttaatcgggcgcccactgacttacaccctgatctttatcgttgatgtcgcgatgctggcaggtatcttagtcttgcgttcaccactgctttttggcatcgcactttgcttgataatgtcgtgttatggcgcgggcttctcggttattccagcttatcttggcgatgttttcggtaccaaacaactcggcgccattcatggctacgtactgactgcctgggcagcggcaggggttgccggaccaacactgctgagctttagcgagcagtacttccacaattatagtgtcagtttgatgatctttattgtccttgaactgattgccttgggattgtcgattcgtattcggcaccagtttgcggacacccaagttaaggatgttacggaataaagtttggtagtcatgacgtacaggttaacttaaggcattaaaagatggttaatggaaaaggccttaagagcgttttcgatgatgatacttaccgtatatataaaatcatatgtatcgaaataataagcaaaatttgatccacacacaaatgtggatctttttttggtttaaaaacgttgccatataagcattgtgaagcttttctacatttaaatttaagctttcaagcgttttttgttgacatacctgtacgtacaagtagaataagcattgtaagtgaaaacggttactggaggaaaaacaatgcgcaagtacgatgctatctatcaggatctgaaggataagatcgaagcagaaatatatgctaccggctcattgctgccaagcgaaagtgcgctgcaagacatgtatcaggcatcacgtgacacggtacgtaaagcgttgcggctgcttaaggatgatggctttattcaatcgcaaaaaggcaaagggtcaacggttatcaaccggcaggaatacgtgtttccggtttccggcgtggtcagttatgccgaattagccgcgcaatttcacttacagacgcgaacggtggttttaaccaatcactttgcaacattgccagccaagtcgttcaaagatgtggatccaacggtagaagtcaaacagatgcgcctactgaagcgggtgcggtatttggaaaatgagccagacatcattgatattgattacctcgatcctaaagtcgtgccgccgattccggagtcggtggctaaagactcactatatgcttatcttgaaggaccggtggggttgaccattgcctatgcaaccaaggagattacggttgaaacggcaacggaagaagatcaacggtatctgaaaataccaccatctgcagtcgtggtcgtggtacgcagttgcagcagtttgacggacaccacgaagtttcaatatacggaatcacgtcaccgggcagatcgttttaagtttcatgattttgctcgccggatccgaccgtaaacgctggcagttcttacttttgttaaaagcaaggacaaggaggttatgatggcgtttcataagaaagttatttatcagttatatcccaagtcgttttacgatagcgatggtgatggtgtcggcgacttacgcggcatcattgaaaagatcgattatctcaaggcactgcacatcgatatgatctggttcaacccattctttgtgtcgccgcaatatgacaacggctatgatgtggctgattatcggcaaatcgatccgcggtttggaacgatggctgattttgaagagttggcgcaaaaacttaaagctgccgggatcgacatcatgttggacatggtgctcaatcataccagcacgcaacatgtctggttccaaaaagccttagctggcgacaagcactatcaggattattactacattcgaccaccaaagccagatggcagcttgccgactaactgggaaagcaagtttggcggtccggcttgggccccatttggcgacactggcaattattatttacatttatacgaacgtcgccaagctgatctcgattggcataatccagccgtccgtcaagaagcagccgctattattaatttttggcgcgccaaaggggttcacggtttccgctttgatgtgctcaacgtcattggcaaggcaaatcagctggttgatgcgccaccggaagtcgaaagcaaaacattatatacggatacaccgattgttcaggattatatcaaggagctagccgccaacagttttggccaggatccaaatagcgtcacggtaggcgaaatgagttcgaccaccattaagaactcaatcgcctataccaagccggaaaatcacgagttatcaatggttttccaatttcaccatctgaaaacggattataagaacggtgaaaagtggagcaaaatgccgtacgacttcaaggcactgcgcaacattttgcacacttggggtcaacagttagatcaaggcggcggctggcaagcgcttttctggaataatcacgatcagccgcgtgcgcttaatcggtttggtgatgttggccaatatcgcgttaaaagtgccgaaatgctagctgccgcgattcacctaagtcgcgggacaccatacatctacatgggcgaggaaatcggcatgaccgatccgcattatcattcgatggccgattatgtcgatgttgaagccaaaaatgcttatcaggcattactgaaagcgggtaagtccgaacaagaagcgtttgccattattgtggccaaggcgcgggacaatagccggacgccaatgcagtgggatgacacggccaacgccggatttaccacaggaacaccgtggttgcggccaaccaatcagcgcgaaattaatgtcaaagctgagctggcgcatggtgaaattttccgattctatcaaaaattgatcgcgttacgcaagcagtatcaagtgatcagcgatggcagttatgtgccttttgggactgaaattgatcgcttgtacgcttacgaacgagttgctggcgatgtccacttgctggtactgaataatttcagtgataaagccattacggtaccgctaccgccacgtttccagcatgcacgcgttttgataaccaatgaagcagatttaacaccaactgcaaccatgacgttgccaccatacgcaacgattgcattgttgcagtcagataagggggaataagcaatgacaaagaaattgcacttaatggcgccggtttccggattggcgatggccattaccgatgtttccgatccagtcttttcacaaaaaatgatgggtgacggttttggcattgagccaaccgatggccaaattgcggcaccggtcgatggacggatcatgatgattgccgataccaagcacgcaatcgggatcaaagccgatgatggcgccgagttattaattcatttagggattgatacggtcgaactcaaaggcgcgccgtttgaaattgatacggcgatggatgcacgggttaaagccggtgatgtgattgggtctatggacttggatgcaatcaaaaaagctggcaagaagaccacggtcattgtcgcgattaccaacacgaaggaagtcgttgatcagctggacgtgacgcccggcgaagtcaagcgcggcgaagaagttgcggtgatgacacctaaagcggccgcggttgaacaagcaccggcagcaccgaagaacgaaagcaaatatgcggccacagcgcggcaaatcattgcggatgtcggtggcgcccaaaacgtcaacagtttgattcactgtatcacgcgcttgcggttctatttaaaagatgaacaaaaaccggatgatgacaccgtgcgtaacattccgggcgttatcgatgttgcgcgggcgaatggtcagtatcaggttgtcattggccaagccgtgacggatgtttacgatgaagtgattaaacaactcggccccggttattcgaatgcagaaggaactgccaaggccattcaagaaacccaagcggaggcaaaagataccagtgcgcttggtacgatcaaacgctgggcgcaagcgttgatcgggacgattaccggttctatgattccagttatcggactcttagccgcaagcgggatgttaaaagggattttgaacattttaacaacatggggcggtctgaaaaccacaaatccaacttatgaaattattaatgcgatgggcgatgcagccttttacttcttacctgtcattgtcggcttcaccgctgcccagaaactcggatcggatccggttattgtcggaattatcggagcgttcctgatttatccgtcaattgctaaaatcgccactgctggcaaagtgaccggcacagtgttaggcatgggcatcaacgcgaacttcttcggcttgccggtgcacattgccaattacacgtattccattttcccgatgatttttgcagcgtggatggcggcaaaaatcgagctgtggattaagagttggatgccgctggtactgcgcatgattttcacaccattagtcgaaatcttcttggttggtatgacagttgtcttggcggttgggccactgatcacggttctgtctaatggcatcacagctggtattcaggcattactcagcttaacgccgatggtttccgatgccattatcgccggcttctatcaagttctggttatcttcggattgcactgggccgtcattccggtcatcaccgcgcaattgtcatcggcacatcccgagtccgtgctgaatgggatcgtatccatttccatgattgcccaaggtgccggtgcattggcagtctgggttaagaccaagcacaatccggccttaaaaggtctgtcaatttccgcctttatcagtgcttgctgcgggattaccgaaccagctatgtacggggttaacttgaaatatggccgtgtcttcatcttttcaagcatcggcgccgcaattggtggcttggtcaacggcttattaaatgtcaacatgtacggttttaccggcagtttcctaggtgcaccttcattcgtagcaccaggctgggctcacaatccgaacaacatctggtttttctggattgcatcacttgtcactttggttgcagcattcacactggtttacctttttggctacaaagatgcggatgcgaatgccgcaaaagcagcacctaagaagaagcgtttaggtaaaacagttgaataatatttgataaggttaagcatgtgttcacttgagtaatcattcgtttgatgacgaaaacatggtttaactttggtcttaagtaaaaacaccgatgccattttgacgtcggtgtttttgtttggattgatgaaagtcggactaacaaaagatttgcagtgttatcgataaaaataacttgcagttggtcaaagattcaggcacactaagaagtgttctcattaaatattaatttttatatggaggaggggccagaaatgtataaacggtacaaagatgtgtcgctgattctgaaaattgtgatcggaatcgtggttggggcagtgttaggggtattggtgccctcctggtcctttatcgatgttttaggcaagctgtttgttggcgcgttgaaggcaatcgcgccgttgcttgttttcttactgattatgtccgctatttccaaatatcgctcgggatcgaaaaaccattttggcactgtcattgtcctttacttaagtgccacatcactttcttcggtggcagctgttgtcgtttcgtatcttttccccatcaagctggtgttaccgggggcgatgaagattgccgaaagtgcgcctaaggatttaggaacggttgtgaccgggttattgaccaatgctgtggcgaatccgatttcagcgttggttgaaggtaattatctcgctattttgttctggtcgttgttgatcggctccggtttacgtttgacgagtgccacgaccaaaaaagtggtgaccgagctggcagagaccgtcagctcagtagcgcaaaatgtcatccagtttgcaccgtttgggattgttggcttattgcatgaatcattgagtaagaccggcgttagaggggtcatggcttatggacaactgctgatcttgctggtggcgactatggtgtttgtctatctggtcgtttatccgttcatggtttggttgctgacgcggcaaaatccttatccgctgacgttttggacgttaaaagtcagtgggattccggcctttttcacgcgtagtggcgccgtcaacattccgattaacctcaaagcttcggaagatttgggcttgaataaagatagttatgctatttctattccactgggcggctcagctaactctggcggggcggccattaccgtgtcgattatgaccttggccaccgctaatacaatgggcgttcatgtcagcattttcctcgccttgttgctttgtttcctgtcagccatttcggcaaccggcgtatcgggcattgccggtgggtcattgctcctgattccaatggcggcttcgctttttggcatttcaaatgatattgccatgcaggtcgttgggattggttttatcatcggtgtcgtacaagactcagttgaaacggcggttaactctgcgtcagatttactgttcacggccacggcggaatacgcggatgatcggcgtgaaggtcacccggttaacatgcgtgctgctgtgaaggcggcaggcaaacagaagcttaagtccgttgcgcctgtggcagaagatgataaatgatcagcagctacaaatgttcatgaatgcttaccctgttgataggtgccatgcatcgttaataggcaaatggaaactggctaagtgagttcagaccacgcttaggcagtttttgtttgcttaaaaaagcttaagatttggcggctcatcattccggaaacttggctggcgagcattcaatgttgtgataacaaatgtcattaaaaacacagcgctttccagtcttactgaaatgtgctaacctatttttcatgggttttttaccaaaatacgtaaaaagagcataaacaagtcaacggaggttccaatggggaaagtatggcaacgattatttcgcaaagaagatccaagtgtgtatgaagacaaagactcgcatttgccgcgggtcttgcgcgtgcgtgattttctggcgctaggcgttggtaccattgtctccgcatcgatctttacattacctggggtcgttgcggctaaacatgccgggccagcagtgtcaatttcttttctgattgcggcgctggttgccggactggtggcatttgcctacgctgaaatgtcagctgccatgccatttgccgggtcggcttattcatggattaatgttgttttcggtgaattcttcgggtggattgccggctgggcgttgttagctgagtactttattgccgtggcctttgttgcgtctggcttatcggctaattttcgcggcttattggcgacgatcggggtgaattttcccgcggccttggcgcatccttttggtactaacggaggcattgttgatttggttgccgtggtggtgatgctgctggtcgggattttgttgtcgcgcggcgtgtccagtgctgcgcgagtcgaaaatattctcgttgtcatgaaagtgctggcgatcctgctatttcttgtggtggggttaaccgcgattcacccagaaaacttccatccgttcttcccggcgtatcatcttaacgcggatggcacaccatttggaggctggcagggtatttatgccggcgtctccatgattttcttggcttatatcggttttgattcgattgcggctaattcggctgaagcgattgatccggagaaaacgatgccgcggggaattttagggtcactcttgattgccgttttcttattcgtttcggtgggactggttttgttggggatgtttccatatcaagattacgccaacaatgcagaaccggtcggctgggcgttgcgccactcaggtcatgcagtggtcgcaaccgttgtcgaaagcattgcggttttaggtatgttcacggcgctcatcggcatggcgatggcgggctcacggctgctttacagttttgggcgtgacgggatgttgccgcatggtttaggaaaattgaatagccgcaagttgccgaatcgggctttggcggtgctcatcactattggcgttattatcggtgcgttctttccatttgcgtttcttgcccagttaatttctgcgggtaccttgatcgcattcatgtttgtcacgcttggcatttaccgtttgcgtccgcgtgaggggcaggacattgccaagccacgttttcggatgccattttacccagtgttgccagcggttgcttttctcggatcgctggtcgtctttctcggattggacattcaggcaaagctgtattcaggcgtctggttcctaatcggttgtgcgatctacttcctttatggcatgcgacactcggcattaaccaaaggctccgaagttgaaaaggagacggaagcactggagcaagcaaagtcggacgagtgaagttgcatgtgaagctacggcaggcaacatgagtgagcgcgtacaggaaagttcatacgcaaagtaaaaatcggcttgacagagacaattagcattctctgtcaagccgattttgattgtcatgcgtacctgctgaaaaaatactgacgatgggttgtgttctaggcttcctgtgccttctttaaattatctttcaaaatggcagcagagtcagccaggcgtttgtggtcttccgcgtttaaatcaagttcgatgatacgttctaagccgtttgcgccgaggataaccggtaccccaatggagacacctgacaaaccatactcaccgtcaagatggaccgacatcgcgaatgctgcccggtcgtcattcaaaaaggcactggtcaggcgggtgagcgaagcggcgattccgtagaaagtagcacctttcttttcaatgatgccatatgcggcagttttaacgcggtggctgatttcagctaaatcacttgcttggcgatttttgggaatccaatcgagaatcggtttgccgccaatattggtgtaatcccaaaccggaaattcggagtcgccatgttcgcccatgatgtagccgtggacaatgcgcgcatccacattgtaacgcaagccgatttccgaacgcagacgggctgaatccagcgctgtacctgagcctagtacttggttacgcggcagccccgattcttccagcactaattccgcgagcacgtcgaccgggtttgaggcaacgagaataaaaccattaaaaccactggccatgatattgtgcgtgatttcttttatgattttggcattgatcgacaacagttccagtcgggtctgaccgggcttttgcgcgatgccagccgtgatcacaatgatatcggcgtatttgcagtcttcataactcgctgcatagatattcttttgggacgtatacggcagcgcgtccgaaagatcctccacatcgccttgtactcgtttctcattgacgtcaataatgcccaggctttgaccaacgccggtcgttaaacagttaaaagcaaagctcgaaccgatagcgccgtcaccaattaaaataatatttccgctatgttgcatcctaaacccctccttgacaggtagccgcttcacgcaacgattggacgatagcagtgtccaaacaatcaaataggtaacatgtatccgatttcattgtaacagaggtgtaggctttcagcttgataaacacttaatctgttatggtcaactttttctcggttctactctaattaagtgatttccgatactccgagctggctccgcggtggtgatggctggcgaccgcgcagctagagtggtgggcacgacttcgaacccgcaaagaccgcggtttcgaagctcggccttggtctaaagcggagaagcccactccgcttaagaccaatttcaccactgagcccgccaccgctccgccagctcttgctttctattacttatagttttatcatcctttcctatcgcttaaccgagagaaattttacaataacagttaatctggctgagggcacatgaagaaaattcttatcaaactgccatttttctgttaaccttaaaacaacacttgttaccgtttttagaaaggtgggtatttatgacttcagcaacagcttatgtcgaatcggttctcgcaacgctcaaacaacgcgatccgcaccagccggagtttttggaagcagcgacaaccattttaaaaaccgttgtccccgtttttgaaaaatatcctgaatatatgaaagcaaacattcttggacgcttggttgaaccggaacgggccatccaatttgccgtgccgtggcaggatgaccaaggccaaatccaagtgaaccgcggctttcgggtgcaattcaattcagccatcggtccatacaaaggcggcttacggttacatccgtcagtcaatttaagtatcgtgaaatttttgggctttgaacagatcttcaagaatagcctgacgaccttgccaatcggtggggcaaaaggcggggctgattttaatcccaaaggtaagtcggatgcggaaatcatgcgtttttgtcaaagcttcatgaccgagctgagcaaatacatcgggccggacctggatgtgccagctggggatattggcgttggcgcacgggaaatcggttacctatatggtcaatacaagcgacttaaaggggcacaacgcggcgttttaaccggcaaaggtctcagttatggcggctcattggcgcgcacggaggctaccggttatggcttgatctattatacggatgaattactcaaggctaatggcgaaacgcttgccggtaagcgggcggtcatttccggtgctggtaatgttgccatttatgctgctcaaaaagctgaagcactgggggttaaagtgctcacggtttccgactcaaatggttacgtggtggatgaaaatgggatcgatcttgccactgtcaagcaaattaaagaagtagaacgtggcagaatcaaaacttatgccgagcgggttgacggcgccaaatattatgaaggttcggtttgggacgcagcgcttaagtttgatctggccttgccgtgtgccacccaaaatgaaattaatggagcgcaggccaagcgctttaaggctgcaggcgtgatcgccgtggcagaaggcgccaacatgcccagtgatccggatgccattgcggcttatcagcatgacgacattttatacggtccggccaaagcggccaatgctggcggcgtggcagtttccgcactcgaaatgagccaaaattcgcggcgtttaagcgatggcttcgacacggttgacggtcagctgcacgagattatgcagcatattttcaaagccagtgccgatgctgccgccgaatatggggttccaggtgattacgaggcaggttccaacatcgccggcttcttgaaagtggctgatgccatgtatgcacaaggcatgtagttggccggatccgatttggtctacaccactcgtggcaattaaccgatcgcaaataaatttgccagaaattcgaaaataaattaggtgtttcttgctgaacgtgttatactctgttcatggtaatacttgaacgggaaacatcatgtaacatgaatttcctttttaggattacggttgtctgttgttgttagttttgaaaaggagattcactttcatgcaaaaaggtacagttaaatggttcaacgctgataagggttacggcttcatcactggtgaagacggccaagacgttttcgtacacttcagcgccatcaacggcgaaggctacaagagtcttgacgaaggtcaggctgtttcctacgatgtagaacaatctgatcgtggccctcaggctgctaacgttaccaagctttaattcttggttcgttgaaaaagatccactcgggaaactgagtgggtctttttttgtgtgagcgcgagccggcgcggttggaagtcggagtgtaagcggccttaggcgtgatggcccggtcttggccattgcgcccaaggtccttacacgcagattgctgcgctggagagcgcgttatagaacgcaaagtcaaaccaaacaatcgcctacaaaagaaaccaatctccgcgcgttatcgcttattctcaaacctttcacaggcagctgaagatccccgcaaaaccaaaaaataaatcctcaccccaacgtccactgccaaacgctaaccaaaacccaacaagcaaacggcattgccacaagaaacagaccaataaacacaacccccggcgcgtcacctgtatccgcccaaaaatacgaaagtggcaacgagatggccgcaatgatgatcgtaatgagcccgagaagccactgaagtcggtgaacgttacggctaacgagcttaggattgcgcactagttgccataacaacaccgcgcctgtgatgatacagccgattacgaaccaaccacctaataaaaccagtatgagaactgtcgtgattttagatgtgaatagtaacaagatggttgcccaaataccgattgccaagaaagctaaactaccaagtcctaagcaaagtggcaaaccaaaccgataaatacttgactggttaaatgatttattcatcttaaacgccctccgtttacctttcactgtaaacttctaaacgggcgagtttcgctaagtcgtgaattcttgtaggaaaagtaaaaaaacgcgaaccagaaatcaacaattgctgatttctggttcacgctaaactgggatggcgcgattcaattcatgacacccgatgaaggaatgaaccaccttactgagggcgttgcgcttattcacctaaagttggctcatcagtgaattcatcgacaatgcggaaggtgacattttcattttctttcaacagtttggcaaccggacactcgtctaaagcctgggtgacaatcttttgggcttcttcgcgagtgtggcttggcatgagaatctgggcatccacaatgaatttgtagccgattttgtcacggacgatatcgacacgggtgcgtaattgggaatcctctgcggtgccttcgcgatgctgaacgatacgaatggtggcattgaaacaagtagacagtgcaaaggcgataaactgctccggattggtacccggcgcatcaatgagcgagctggaaacgcccagtgctaatccttggttgccttcaacataactttcaccaaccagaccattttcgttacggacataggtatgatataaagaacgctctgccatgctatccatcctttctttgagctttcatcgtgagtataccatggaaccgcttaacatggtgttattgtggctcgcgcgcgcatagctttggattttcgtttatagcaacgggtgtaggcgaatcatctttgtggcaacctgatcgataaaatgttcatcgtgttcgacaaagagcatcgttggttgatattggcggacggccgcaataatctgatcttgattgtaggtatccagataattaagtggctcgtcccagatgtaaagcgctgcaggcgttgccagggagcgggccacttccactttcttttgctggcccatactcaaatgttcaatcggcgtggcaaaatcagcgcgcggcataccaagcttgcgtaagttattgagcaatgcttcgcgactaagctggtgggtttcggcaaagtctggaagggtaccgcggttatcggcatactgctgacgtaccagactcagagatacgggtgccagcttcaacagaccacggctgattccgttaaactgacccagcaatgcgcggatcaaggttgatttaccactgccgttttccccaacaatggcaatgcgatcgccacggtgtaaggtgaacgaaatcggctcgaataacggttgctcaaagccgagttgcaccttttccgccacaatcaattggtgctggtgggtcggctgcggattcatcgttaaaggatcgactttttccagatttttgagcagctgttctttttcttcgatttctttgttcatccggtgttccaggtttttactttttttcatggttcttgctgcgcgggcgctgataaagccgcgacccctatgaccgctatttttaacgtgccgatcgccgtaaatactgcgctctttattttcggcccagagtttcttgtcataagccgtttgtttgagccgactgatttcggtttttaaatgggtattttgggcaatttcggtttgatcctggcgcgctttttcagttgcaaacgtcgtgtagttgccttgatatagcgtgattttctggcgttcaatggccaaggtgtgatcggtgatagcatctaaaaaatcgcgatcatgactcacaacgataaagccgggtttttgctgcaaataggctgctacctgccggcgactgcgcagatcaaggtgattggttggttcgtcgatgagtgcaaagccatcggtctggatgaaaagcaacgccaagcgcactttggtttgttcaccaccggataaatcagcaaacggtcgccaaagaatcgcaggatcggcatgcaataagttgagttcgcgctcaagttgccactgggcgacatggttaaacgcctgagcagcatccaatgtcacctgagattcatcgagtccttggggaaaatattgcagcggcagtggtacggtgatcgtaccgcgataatcaagttgtttttgcaataggcgtaacaaagttgttttgccgcgaccattacggccaactaagccgagatgccagtttgtatcaagatcgaaaccggcatcagtaaagatcggtgcttggccatcgtaagcaaagtgtagatgtttgatttggatggtagacatacagccacgtcctttccgggatgtgcctgtggtatcaagacgggtggtgctgcggtgctttttgaaatcgggttgtgatgagcgtgaaaatgctggctgataacgcgccggttcacgctcaccataacgcgttcaccggcgcagaagtctgcgtgtaaggaccttaagcgcaatggccaagaccgggccatcacgcttaaggccgcttacactccgacttctaagcgcgccggttcacgctcagcttcataacgcgttcaccggcgcaggaatctgcgtgtaaggaccttggtcgcaatggcaaagtgcggccatcacgcccaaggccgcttacactccgattcctaagcgcgccggttcacgctcagataaaaaaggtcagcccccaaaattaaggctgaccaaaatagacggagtgtccgccattgatcgcgcccgattgtcaaaaagtccacacgaatcccgttgatgatgacaggacttggacatttcaacaattggcgttcttcaatggacgagacctcactttcgatttaaagttaaactaaaattaccacgtgttttgtgctgcgtcaactttttacggcttcttcaattggtgttgggccagtggcaattttaattgtttcgcggtgacgatcactatctaatgcggcaaccaagacatcggcaacatcggcacgcggaatggttgatgggcgttgcggctgcagcgtaatggttccttgcgccggttcattcgtgagtgaggttggctggacaatgacataatccagatccgtattgtggattaaccactcatctgcataatacttagcaatgtagtaatcgtgcaattgtgcaggccagtgtgccggatcctcagcatcaagtgcactaagcatgatgaagcggccgacatccttggcttcggcggctttcatggttttgatggccccatctaagtcaaccccgagtaaatcttttccccgcgatcctgcagcgaacacaactgcatcatgaccggcgaaaaggtctgctaatcgattgaccggccatgacagatcaagctcaactgcgcgaaagtttttctccggatcgggtgtctgggtgagcgggtcacgatagcctcctgtgaccgtatcgcctcgatccagtaatttatgcaccaatagctggccgatttgaccgtgggggccgacaacaaaaattttcacaacaatgatcctttcttggaaaatgattgttattagtataacgttttttgtgctgacgtgaaagcgctcgccgctgactgaacacagcagtaattgggatgaggcgttgttttgactaaatgatttccaggggaacgtgatgacgaggcatcgggaaggcttgatcaaatagatctaattcgtccggtgaaaatgtgacgtctgctgcggcaatgttttctgccatgtggctagcttcaccagtgcgggggatggatagcacgtcaccattgcgcaatacccaggcaagcaggagctggtgagtcgaaatgcccttgctttttgccaagtcggtgagttccggagttagcttgatggatttgccgctgccggaaccataaggcgagtaaccaatcgtggtgatccctgcctgcttctggcgtggaagtaggtcaaagtcaataccgcgtgattgtaggttatacaagacttcattggcaacgacttgctcgccacccggttccaaagtgagctgatccatatcgtcaacatcgaagtttgagaccccgtattggcgaatcagtccctcttttttcagctcttgtaagccttcaagggtttccgccagtggggtagccccgcgccagtgaagtaggtaaagatcgagataatcggttttaagtcgcgacaagctatttgtcagcgccgttcgcatttgctttttgtcggcatgtgacggatagaatttagagatcagatagatattggcccgtgggtaatcgcctaaaaagctgccgatcaaggtttccgccgcgccgttgccatacatttcggctgtatcaatcacccgcaagccgtgatctaacccgtactttaaagcttgggtttcgcgtgcgctttgttcagcgttgccttcacctaaataccaggtgcccattccgacaattggaaccgttacatcgccaatattgatcgttttcataaaagcaaacccctttcctttgcatgtgtttgccacttgttccggatgagcaaacacaggctgcttcatacagtttcattatacaaattagccgtgaaataaaaacactcatagaaaaatgtcagaaaagatgcaaggtgagagggtctggcaagtgaaagtttgaaaaatttgcagtcagcgcaatcaggacatagctttaaaggtcattgtcttgatccattaccggctttgttttgctgtttccatggcgataatagatgaaataatgcaagctcaccaaacttaaaaagataatcccgactactaatgaaatacttgtttccggattcagcaacatgaaaaataaagtgaacacaaggaaaataagtgtgagataattactgtatggtgcgaatggcattttgaaaggatggtccgtcattttatcggcgtgaacttttcgaaacttgatttcactaataagaatcacaaaccagggaaccattcctggcaagacgctggaactatagacgagaacgaaaacatttttcgctgctggcgccacgtaaggcaggatggcgtttaaaagcacaccgagtaaaatgccgccgccgaccgaaacaacgggataaaaagggactccatggcgatttagttttgtgaagattcgcggtaactgtttggcatctgccaatgtgtaaagcatacgactagcagaataaatgccggaatttgaacctgataatgcggcggtgatcaccacaaagttgatgagtgatgccgcaaaggtaatgccgattttggcaaaggtttgaacaaaaggagaccctaaagcgctaagttgattccaaggataaacggctacaatcacgaaaatcgcaccaacgtaaaagataagaattcgcccgatggtgtctttgaccgctttaacaattgttggttgcgggttttccgcttccccagctgtgatgccgagtaactcaacgccttggtaagaaccaagtacaatggacaaggcaaagcaaaagcccgtaaagccacccgtgaaaaatccgccgtgggtccacaagttactaatccccactggccgaccgccatttcctagtccaaataaaatgacgccgagaccagcgatgatcatcaacacaatggttacgactttgatcaaagcgaaccagaattccaattcgccaaacattcgcaccgaaatcagattcgccaaaacaaggaaggtgatcgcaaccaggccaggcagccatgccggcagcccgggccaccaaaatttgaagtattcaccaatggcaatcatctctgacatgcctaccacaacaaattggaagatattactccacgcggttaaatagccaaaaagcgggtgcatgtattcactggcaaatttggcaaatgaaccagttgccggatcaacgtacagcatttcgcccaacgcccgcatgatgagataaagaaaaagtccggcaatgatataggcaattaagacagaaggaccggtccatttgatggtggcactagcgcccatgaaaaggccaacgccgatggttccgccaagcgcaatcatctgcatatggcggccactgagttttcgttgcatgttaagttcgcttctttcattgttgtgacatacaagagaagactatacaagaaaagtctatttttcgcaaacagatgaatttgaaacgtagacatgattaacgcgttaatgtaggctattaatcaggtcataacctaggaaagtacgctgattttgtcgtttaattgttcgaatatcaggatagaaagcaagagctggtggagcggtggcgggctcagtggcgcccaccactctagctgcgcggtcgccagcctgccaccgcggagccagctcggagtaacggagatcacttattagagtagaaccgagaaaagattgacacttaccgtttgattaaggcaatgttcgcgtatgactttttgcgttaaactagtaccggaacacttaaatttaagtaggatatgaggaaatattttggataataagctaaaaacatcattaaatgcttatatggcaaagcatggattgaataccaacgccgcttcaatcgcgattggtgtatccgtaccgaccctgcgaaaggcgctgcgtggtcataacgtcagtcgtaaaacgaccgcaaagattgaaagcatcatcgcatcgggaaaagtcccggaagcagcaaagaccacggtaaaacggaccccaaagaagacagctgcggcgaaatcagtcgctaagactccagccgctaagacgcgcacacggcagacgactgccaaagcgccagcaacgaaaccaagcacaacgaagcaagccgcaacaaagacgccaactcgacaggcaaaaacgcaaacgcagccaacaagtattgctgccaccgatcagaatcaggcggccgtacattctcaggaaaattcagccagtccgcaatcaccgcgccggacaaccaaacgagttgcccgcacaacaacgactggccgacaagtgaatcgcaatacccggcaatcaccgtcaaccaatggtgctaacactgcgagtgagtcacagtcgaccaccaaacggccgacaacgcgcaatcatcgtttcaccattcgccagcagcctgatgtcgcaacccagcaagcacaaagcgaggccaacaaacgtcaggcgcaggcagcaaacagtcagtctaccgctaattcaatgagcacgtctgaaagcaccgaccgccgcgaaaacggtgtgcgccataccaagcaacacacaccaaccggaaaaacagatgcaacgcggcacaacagtacaagcgagcacgaaccggttcggcgtgatcggcgcaatgtgcggctcgatcgcaacaaacaaaacggtacgcggcgaccgggacggccaagacagaatcgcttcgctgccaatgctgatccgcaaaattggcaacccatgacgcaatcagcttctacaagcaattcacaatcgcttagcaatcaagatgccagtcaacaccggactcctgctgttgttaataaagtgacaacccacacgccaagcgtcatccgatccacgtcagctgatcgtgctagcacaaacggtagcgctgcaaacagtactagcaatgccgccaatacacagtcagcggagaatcggtcggcgcgcgccaattacggaacgcatgatgaggtgccactggtaaccgggaagcaattacgtcttttcattgatgaaagttttgaagagcatcgaccggatccgcggatgatgcatatgggaattgccgccattttaccggaaggcgacgatgaaagcttagccggtttccggaacgcgctttatccctatggctgggagccaggggatgaagttaaagcccgcggcaaacaggttgatgcattgacgcaactgattaaagctgccaagcatgaaaacatgggcatgtatacggtcttttcacgtaaaacaacttacccggattttgcaccatcaatggaatatctttatccatatatcggagcaaccatccatgtcttgcgtgatgtccataccacatttgatgatattgtgatcatgatcgatcatcgaaatgagttggaaggcaatcagcttgtgatgggcgccgatatcgttagtcgttacttgaccctgtcactggaacggccaattaaggttcggtttgaatttgcggactcgcgtgaacatcttgggttgcaactatccgactttattgctaatgctgcgttgcggttaagcaaagatgagctcagtctgatcgggatcacgccgatgcctgaattaggcatttcgcagcacgatcagcttgttcgccttactttattgggcctgcaacaggttgtcatgggggttcgcgcggaacgggccgcaatgccttccaagcattcccagccggatcggttcatgcagctgatctttgatgcaacctacgccgattcggatctggtacgcggggctttaccggttgtcaaaaatgcggtggaacaactcattgatgtgttaccaaatgctcgtgtcggtcaaatctccggcatgccaaaccaaagctggtacgacatgactgcacgcatggccggcttgttacgctacatcaataaggatccaaagccatatggtaaggttctagccaagattgaaagtgttacaaagacggctgccgatgagcttgaaatggctttagactcaggttcaaagacaaaacggtaaaagagaccgttcgttgagttaattgcaaaataaaaaccggttgtagagaattttctctgcagccgatttttttattttgcaaggggcatattctgaaatgaaagaaaggcaaaatagtctagtcgataaaactgtcctgatttttcaaataggtgatttcgtcaaaggtgattcgggtttggaggcgctgcatgaggtcgcgacttagctttccatccgtaaaagcctgttgaatgaactcgtattcggcatgaaaggctttaagaaacatcgcgtacaaagcatccccgtcaaatgactcggaatggacccggcgatgacgatcacggtagaaccgccgaatggtattaaccgcactgcgattttgaattgtttcaatccgttgcaaatatcgcatgaccgccgtatatccagcctgttcaatgggcaagagatcttcgccgtgagccgcaaattggcgtttccaatagatcggctctaggttgagcggggtggttaaaaaggcgttttgggcttcattaaacgctttatacatccggcccatgttgaacgaaaagcgaaaccggagccaaagatttttccagagtcgttgatccgccgtgaaatcattgagatcaatgaagcggttataataatgggcttcatcgcgagtaatcgtgccgttcatccgtaaggtttcaatggcacttttttccgcagtgatggtgccttcaaaaatcgttcgttgcagccgccgcgaaggattgtcatttaagatcatttcctgagctaaggcatcggcgacaatttgtgcttcactgtgatgttcggtctcatcgcgcatcgcatcaatgcccgccgccagcatgcgccgtaaccagataaattggcgattgcgttttggcggtttagggacgcaaaacggcaatatgatgaccggaacgatgagactgaggagaatctcaacagccgcaatgagaatgagtccttggcgcagggcaaaatggtgaccggcaacggtttgcgggatcgaaaaagccagcgataaagtgatggttccatttgcaccaccgagcatcatgatcaacgcattgcgccatcgatgtttcttgcccattttcaataacgtccgactccagatgaagcgaacaaaggatttggccacgtagatgaaagcaccgatgccaatgagcaagccgaataaccctgcctgcccgcgtaatgcctcaatcacgacatttggcagcgaaacgcctagcaaaacaaaaaccagcccggaaagaacggcagcaatcatttcccacacattggcgctaataatttgcatgcgggcactggtcaaccgcaagcgatcacgctcaacgccttgggcaatccctgcagccacaactgctaaaataccggaaagtgccagttcttcagccagaaaataaaccagtaacggcgtcagcagctgaattccgaccataattaacggctcatcatcaccgatacggattaaccaggctctgagattgacaataaaaatacctgccagtgcgccgaataaaataccgccaaagaaaacaaacaggaagtcgagcaaagcgtcagtggccgagaattgtccggaaatataggccgacagtgcgagatcaaacgccacaatccccgccgcatcgttaaacaaactttcattatttaacagctgcatttgactggtgcttaacggattggcctgtgcaacggcactaacagcggaagcatcagttggggtcacaatggcaatcaaagcaaatgccagactcaatgggatgaccgggaaaagtgcatggacgccgaagcctaagatcacgaccgacacgagcaccaagccgactgcaagtgacacaatattcgtcagtgaccggccgatttgtcctcgtgaggcattttgaccttcattgaaaagcagcggcgcgatgatagcaaaggagaacgccgatggatcaatcgtaaaactacgcagggatggcataattgccaacgctgcaccaaggccaattaagaagaatggcaagggaatctgcgggacatggcgagcaagcaaattgccaacgataaccgtggccaacatgatgccaaaaataacgacttgattcacagcgactcacttcctagcttgaccgattcgatcattttattttagcaccaaactggggaaaacactggttgcaggcttggagagcgtgaaccagcccggtttctggacaggtgaacgcgtttggatcgcctagacggtgcgcaaacggacatactgattaaaaatcggattggtttatttttcagcctgatgtgtcgatagtagcagtgggagcaaaaaaagtgtcgggaatatttcgacacttagtaggataagactattttccttgacgtttttttaacacgtggttcatctttctagctgtgacctgccaggaaagataaagcgccagccagatgaggacgtaaatgatcaaaaaggcgattagaaaatttgggagtgccgatccgacgagaaattgccagcccatgagatagttggtgccgatgacaatggcgaaggtgccgataaaatgaaggctataggctacaggcaggctgagggattcattgtcaaaaataagggcgagcatcccgattaaagcgctcatcacaaacaagccagcgatggtgcgtggcgttggtggggtcagttggacgtgtagcatgagcgcacctagataaacagtcgcaccgatcatcataccgataacgctatccgtgataagatctttgatgattttcatcgggcacctcacaatcctaacaagcgttttaacgcaggaagatatttacgactgacagttaacttcattttattcgccatgaaggctgtcatgttcccggaaaaagacgcttctagtgacgttaaataattaatattcaaaagactgcttttcgttacttggataaatgcttgcgggtcaagtttggccaagaccgttttgagttgaccgcggctttgataaatatcttgatgggtatggacagaaagctgatcgccgtatacttcaacagccacgatctcgttggttggcaaaacaacaacgcgttcgccaacgagtagcggtaaggtcgcgtggctgtcggcgagttgctgaatttgttgcagtaactgcaaaacagctggtgacaatcgtgcagccttgacgtgaacttgcacgtcgtctggctgcatcgttgcgtcttgctcaaacgaaactttcattgacacccctcccgtaaaaagtgcatgcatgatagtgaaacgaatcatggcggtgttgcgataatattggaaaaagcaaccatgataatcaaattaattatacgcggacaagcgctgtttttcgactgactttggctatcagaatgatgaccagtccgacaagcagcgtgaagctagttagaatcaggtaagtttggcttgatgaaagcaggccatgcagatcaattcggatgccgagcattttttcaaaggtctgacgcgccgttgtctggtgaacggaaaaagtggactctaggggttgctgtaggagtaactgccggtatattgcggcattgtagggaaaaggcgtcaatttcatcaaattttgcgcggcagttggaacagaaccaatgggaagatagacgccagcaaagaaaccagctgcggttccaatgatcgtcgaaatgccgctcattgtggtgacccgggacacgaaactaagaatcaaaaggttgaaagccgtccagactaagctgctaaacacggcaaggacgataatctggccggtcaattgccagggaatggcgatgtggtctaaccataaaaaagcaccagacatagcaaagaacataagtaactgcatgatggtgccaatgatcacggcgctaatcagatagcccaactcgatacgtaaatacgaagcttgagttaataaataatcgctaagtcggccagtttcgcgatcaacaatcatccgcgcgagaccattttgtgtggtcgtgacagcggtgatggttaaggtgccgccaattaaccacggatccagcaatttttcgggatgtgccagtggccaaagcgtgctcatacttttcttgagaaagactaaatacagtaaaaaggcaattaaagcgcccagtaccgagaagaagaccccggcgcggttgcgaaagaatagtaacaaattgcgtttgacaaatgcccacatgttaacgaatctcctttccggttaaagcaacaaaaatggtattcatatcagccgcacgaaactcaaagtcaatgagctgcggttgtatagttgtcagtaatgtgatggctgcttggggatggctaacctgcacccgcactgtgtcaccatcgatctgggcggggagattcgcttgggttgcggctatttgtacttgttgaggtgcatgcgtgcgaacaataagctgatgtccggcatactgttgttttagttggccaacagtgttcgcggcgataatcgtgccctgatcaatgacatagacaaaatctgcttgttcggtttcttctaagtaatgtgtcgtcaaaatcacggttaactgtgattgcgcacgtaaggaagcgatggcggtccaaatggtttggcgggtttgaatgtcgaggcctgttgttggttcatctaaaaaaaggagatgaggatgattgagcaaggcgcgcgcaatatcaacacgccggcgctgaccaccagacaatgtgccgtaagcttggctaagaattggcgtcaaatcaaattggtcgaccaagtaatcaaaccaggccggatcagttttggtatacatttgggaacggattttcaagttctcttttacagtcagctgccgatctaaacgactgtcttggaagacaacaccgatttgttgccgataagccgcttgattcggcgtggctgtgcccattgtgatcttgccgctgctgggttgaattaatcccgtcagcatgccgatggttgtcgacttgcctgcaccattaggccctaaaaaggcaactaattgaccggctggaattgttaggttgatatcattgacggcggttttggtaccgtatgtttttgtcagattcgttgtttcgagaaggatcatatctatcaccacttttgtttgatgattcaagcatagccagtgcgagcgaatccgtcccgctgatgccgataagtggtcaaaattgcaaggtgagtggtcagatgccgagggcgaatgacagcggatatttaactttgtggacaaaaggaaagtgaacgtaactgcaattcgtcatgacaagaatttgaaataagttcaattaatgggcaccaaaaaaaacgatgccagtccgaaaacactagcatcgttttaaacattgtccagttgtttgaagtaaaaacagcacagcggctaactcgaaattcgcgtcaggtaaacagaaatgccaaaattcttgcatcaacgtaaggattctggtgcagactgctgtgataggcaccaagcggcgttccgtgatagatgtaaagcgtacttggaatatttgccgcgcgcaaggccttttcaaagcgcttgacgccagcgatgctcacggcccagtcgccacttgcaccaaagatttgaccgccgatgacgagggtttggactgatttagggaattgctgtaattgaggtgtggggtcacggtaaaactcgcttgccaatgaaacgtacttcactacatgcggctgcgcatcagtgtggtgggtcgtgaggtatctaaaactgaggttgctgcccatagaatgaccgacaagattgatcttggtgacgttgtgtttggcacgtagccaatgtaacaaggcagtcagttgtcgggtttccttttccggggctttggcgtcttcaaaaaccacattaactaacggattcttgccggtataccggttagcgccagttatcgtgcggctgccggtcgcgctgatggtaatggtcgtcacttgattggaggcgcggtcttgcttgaagcgggtcaccatcgggccaaaagtcaggccattactggcatagccggggacaaatacggtaacgatggatgtttgccggtaagtctgggcatgaatgcggcgactgcctagctgccaccaaacccaataactccctgccaacagtagaaagagtatcaaaagtaagcgccatccccagcggtgctgacgtgattgtttgcgtgtcatgttgcgacttaccccttttaacaacggtatttagtcaaccaccggtgatagcaggcacggccagtaccgatttagttggcagttttggtaaatacgctgcgcaaaaccggacgctgataacgcgcttgaatatggcgatgattatctgcaaaaagctgctgataacggtgtaattgctgcgtgccaatggtaaccgccgtttgatcgatgacataccaagcaacaccttctgtcagcggcggcgtggttaaggagccaagatagcgatataccgtcccttgttgcggaatgagctgatctaggctgaaggcaacggatcgggttgaatgggcggcaaaatgatccagtatttgctcaagcacaacattgtcaggacccaacggcaagagaaccgcaacgacgcataaggcaccgattgctgactgatggacgaaatgcagttcggcagcgtgttgattggtgatttggtgttcggcaggtacatgaatatgggcctgcatcaattgccactgatcctgatcaattcgggtgcgaccggttccggtaagccggatcgtaacctggtcatcgatttcttgtgtcactcgccacgacgtttcaattttcaacgttgacgggtcagctggagttgccggtaaaagattgatgggtgattgaagttggccaaaaccattcggccatttttcctgatggtgataatctaaaactgccatgttcattgattcctctcatcactagggaataacgttcttgttgattttaaaagccagattcaaccgcggctgaatctggcttttgtgtaagcgcgagccgacgcgttatggtgaaccagctagtcgagtagtttaactgccgtgccgtatgcgacaacgctttgcatatcgccgccgattgatccggagtcaaatcgcatcatcaccaccgcgtcgccacctgctttgcgagcttcagtacgcaagcggtcaattgccttttcgcgcgattcatgcagcatatcgctataggccttgatttcaccgccaacaaggttcttcaagccagcaccgatgttactaatcacatttttggactgagtggttaagccaaaaacttcgccaatgatttcgtaatgtttcccgggaatgttctcggtggtggtaatcaaaatttcctgagccatcatgggcctccttatgagttgcttgatcgttacttatgtacagcggaccatgtatcacagtctcaccgtgttttagcctaccaccggtgtttgccgacaacaagcgaaacgactttaacaacggacggctgcggttggttattgaccaagctgattggcgcgaacaagcaggccccattaacatggctgcttgctattggtcaggctgacttgatgaaacaagttggtggtttattgacgttgttttgtttgcaggtaggtacgatagacggctaaagcggcattatccggtgaatcaggaaacattttttcgggcgcaagcgatgctggcacccatttggcttcggaaatttcaggtgaagtgactaaagactgcttggaagtatgactgataaagccatgcatgagactgccagttttcctgtaccaatatgtgccagcgtagtcgagttgatccagatggatgccgagttcttctataacttcgcgcttggcactctcctcagcgctttcacccggctgcatataacctgagatgatagagacatatttttcagacaaataaggcattttcaccaatgcaatctcatcaaattcattgacgaccagtacgaggacgcaatcggcaaataatggaaaccaaaagcgttggcaagtttcacagtaaggcacattcccatcatcgcctgccaattttggggtgagcgcgtggccacagataggacagaatttaaaagtcatgaggggctccttggggttgagattctgtaattgaactcgctttcataacgaaattaatgatattataaatcttaataatgcctagttgctgcaagcatggttttaaactgaaacatgaagcaggaggcatacggttcaaaattaacgtcatacaggaggaggagttcaaaatatccaatgcaaagatattactagttgaagacaatcgagaatttagtgaattgctgaaactgtatttacaaggcgaaggatacattttaactagagtgtttgatggcaaaattgctatggatacgattaagaataacacttttgatgttgtcttgttagatataatgcttcctgaaaaaaatggttttaatgtgttgaaggaattgcgccagaccaagatgacaccggtgattatcataactgccagagatatggaccaggatgaggttttgggattgagcctgggagccgatgactatctgaaaaagccattttcactggtggcattaaacgcccgtataaaggctcaaatacgacgaacgactcaatacgcggtatacggttatgaaaaaatgcatacccagtcacaagttacatttgctgatttacgattagataatctcaatcaaacagtatataaaaatgatcggcggctcaatttaactgtcaaggaatatagacttctaaagcttttaatgattcaccctggtcatgttttttcaaagcaagcaatttatgagaaagtgtggggggaatcctatattggcgatgaaaacacagttaatgtctgcattaagagattacgcgacaaaattcaagacgttaaccagcgctacattagaacagtttggggaatcggctatgtcctagaggcgggggtagaataatgttgcttatgttgactatcgtgctagctgcctttcttgttatttctttagcctatatcatttcgttaaaaacgaacttgaaacgagcaggtcaagaaatttggcgcttatcggaacaagagttttcgatgccactattacaacaaactaatgtcaaagaattacaacaactctatgcgagtatcaatcatctattaaagcttaatcgagataatcgcctcgcatatgaaagcgcttatcaaaagatgacacagacaatagctaacataactcatgatttgaaaacgcccttagccacagccttaggatatttagaaataatggtggcaaatggatgtcagtctgatagcgtggtaaaggtcagagcaaagagtttggaggtccagcaccttataaaccagttttcacagttgatacgaatagaagctggagatcggcgtaaacaagtgcggttagtcaatattaatgagctctgtcgagaagcgttgttttcaatcctagctcaactaaaggataataagttcgaagttgttgccaacatacctgaataccccatctggattaatagtgacgatgatgctattcgtcggagtttaaataatttgttacaaaatgtttgtgttcacggtgaagatggtcattatttagaattaatcttggccgaaagacttggggaaatccttataaaagttcgtgaccatggtaaaggtattcaaaagcacgatcttgatgcaatttttgagagaacctttatggctgatgagactcgttataagagtggtaaaggtggggggctgggtttggctatcacaaaagctttaatagctcaaattcaaggttgtatttacgttgaaagccaaccacatatttgcaccacgtttaccatcgtgctacctaagaatgcaaagtaaggagtttgtaagattttcgacagggaagtgttagaaatacccattagactataacttgtcaacagaccaatttctaaaaaggatgggaagctatggactactgcattcaaactcagggattaagtaagcattttaaaggggtaacagctttaaagtctgtaaatatgaatgttaaactcggcgagatatatgggtttcttgggccaaacggggctggtaaaagtacggtttttaagctgttgatggctttgctgaagccagacgctgggaaaattatgcgtcaagccgaaactctgtctcaggggttaaatggcttttttagacaaacgggttcaattatagagaatccttatttctatgaagacttaagcgggtatgagaatcttaagatccatgctcgctacatgggttattatgtggagaatgatgcgcagacaaagataaaagacattttaagactagttcacctgtctgataccgaaaagaagccagttagagcttattccttaggtatgaagcaacgcttagcgatggctagagcattgttatgcgatccaaaacttttaattctggacgagcccttcaacggtttggatccagagggattagcaaagatgaggcaacttcttctggatttgaatcaaaggcaacgtacaactatcatcatttctagtcacttattaagtgaaatatccgcaattgctgatacgattggtgttttgaaacagggcgttttaattcaggaaatagctatggaaaaagtcaggcagaaggaacgtcagtgcattgaaattaaagtaagtaatcctaatagggcctcctgcgtgctggaagaaaaactgaatattcatgaattcgatttggtctcaaaccacaaaattctaatttatgataccgaaattgatcgtgctttattaatcaagactttggtaatgaatgatgtcggaattaaaagtgcatttcttaaagagggctcgttggaagattactttttaaagttgacgcgatagttattattaaagtgagggctaccatggaaatgattaagctagaatttgtgaagtttcgcttacaacgacaaataattggtgttgcattaacgattataggcttgcttctctttttgacaatttcctttgtagataataaagtgcatacaaatcaggttttagacactagccaaagtgttcaacgaatgattgcttttttggctgctagtatgtttatggtgtatgcagcaggtttgatatctaaactaattatcggtgaatataaccatcgaacgattctcatgctattctcttatccaatcaatcgaaaaaagattattggagtcaaaatgggtctaattactgtatttacattgatcagtacgtttactacatgtctattagcgcacttttacgtttattgtattgatcatcaattcatggttaccgcaaatacttttacgcttacttctgacgttttgatggggtatttttactgtagccttttagcagcaatgattgctctttgcccattcattcttggcatgataaagaaatcaataattgcaaccatggcgacagctgttcttggtataattgctattcagactatggtgccaaaagtgcttgtttggaaccgcgattttcttaggctcgctatactaggacttgcattagcatctttgtcttacatcatcgttcaaacgaagattctggattttgataagtagtttttggattgacggaagcacagggaagctgttacataattcgggagcttaaacaaaagtatccaaatattaagacggcagaccataatttcaaaccatggggaaccatgatttgtcagattctgaacgataaaaagaatggacggaaattccgtgctgtgtcaagatccgcaattttcagatttaactttcctttgattgctctgccttggcgcaagctatttcaattttgatgttttcgcttacaccttcgaattatgaaccaaccttacctaagtagtcgtgcagtgtacttgagtggatagtaaagtttgatgttaattagttactcgaatgacaatccgaccctcgtggtgactgtcatccagcaactggtgccctttgacaaaaccttcgcgggtaaatggcaacacgtagccgacctgaacgttgagcttgttttgtgccatcagatctatgagcagttgcaaagctttgcctacctcggatccgccaagtggccgggtatgaataaaacgaatgtcccggctgagtaaaggttctgtgtggctaacggaaacgatcagtccgttgtctttggtcatagcgacatcatcatcaccaccaagcccgttcatagcagcgttaatcacgacatcggcagtctggcgcagttgggtgacgggattaccctgatcgtaagcgacaaagtgttcaacgccaagccgctcaaccgcgacttcatgacggctgctggcaatgccgatgaccgaggccccgtgcgcaacggcgagttgaattgctgccgagcccaccccgccagaggcacctttaacaataacagtatcaccagctttaacattgcccagttccaccatgcggtaaccggtgacaccaggggtaatgaccgctacgcctttttccggagtaatcgaagctggtaacaagacgctcatgtcagctgcggcagtgacgatttctgcataggcactggttgttcgcgccaccacgcgatcgcccactttaaactgagaaacattgctcccgagcgcagtgacgttaccggcaacatcgtatcccggtactgtcaagccactgccgcctagttgccgcgccatgcgatcacggttattgagaccgattgcgctagtcttaatttgaatttcatgaggtcccggttgtggtgtcggcaagtcaattgcatcaatcacttccggtccgcctgcatgactaaacccgtatccgatcatcatgattcctcccatcatgccatgttaaactagcggcattgtaaccatgatgcgaggaaaaaaacaattaaagtgacttggtgtgctaaatatcacccgttaccttcaaatcaaatcgccatcagtggctgatacgttattcagcggtcactgatcattttgatgtggtcggggatcgaagccgtgtagctggcctttgaactcatccggaaacgagctgaccggcgtatgctgttcccagctggctgcaacttcttcgtcaaccggttcggcatgctcactgtagtccagccccattttttcagcggctggtgatacgcggatggcaacaaactgggtaaggatactcgtaataatcgtgaccatggcagcgaccaaagcaatcacgatgatggtaccggctagctgaatcagcagcagatgccagccgccgccatatgcgagtccggcgtgggcaatgcttggggccactgttttgctggcaaagaccccggtcaggacactaccgacaatcccggaaacaccatgacagccaaaagcgtctaacgtgtcatcaataccgagtcgtggcttgattttgctgatgaaccagtaactggctaacgttgatgccacaccgatgcaaaccgcaccaaaactggtcacgtagccggttgccggcgtgattccgaccagtccgcataaagcgccggtacaagtgcctattaaggttggatggcctgtttgccaaatatcaaggatcatccaggtgactaaggctgctgcggcgccaaccgatgtggtcaaagccgccgtcattgccgcctgattgacccccagcgccgacccggcattaaagccataccaaccgatccaaagaatggctgttcctagcaacacccacggccgattgtaaggcaccgtatgctcatccgcgcgccggccaagaaaggcagacaaggtcagtgccgtaatcccggcgttaatatgaatgacggtcccaccggcaaaatcaagcacgccaagcccagccaacaagccatccggactccaaattaaatgtacaagcgggtaataaaccaatagggaccacaggacaataaaccaagtcaagaacttaaaatgcatgcggccaaccaccgcaccgacaaacagagccggcgtgatgatagcaaacatcatttgaaagagaatgtaaacgccggttggaatcctagccgccgttgccgtaccaagcgagacgccgctaagaaagagatgctgtacctggccaatcaccccgaaaagattaccattgaagctcaattcataacccacggccacccacagtaaaatcgcaatcccggtaatgtagaagactgacagcatggtattaatgacgttgcgcttagagacgaggcctccatagaaaaaagcaagtcccggggtcataaaccaaaccagaacgcttgcaatgatcacaaatcctgtatcggctaaattcatctgtgccacctcattcatcttgaatggcggtattgtagcacgggttttgccggctacgacgtgagtgccggtttcattgatctagaccaaacgtgttatcgtggtgacaagacttgatttaaaaggatttatggcacggcaaaaaaatattttgaacgtcagcttatataacatgaatgcttgacgatgatttggaatttgatgttttttactgattggtccacatgaaaaacagctagtcatgtcaacattaaaaaagcctcaacaacaaatttgtcgttaaggcagaggctgagcacccaatcgtcatcagcgtttaacctgatggcggtatcgtgctaaattatagttccccgtcagcaattttccccaatacggatttagacgggatgaagaagagttcgcctgttaacggggttgaaaagtccaatagccggtcggatttttcgaacattccttgcaacatccgttttgtgacggtccaatggcgggcatagccgataaagtaggtgccgttgattttttcagccgggttgctgaagggcacgttcatgcggacaattttatgttccacgccgccgtcattatcctgcgaaaccacgttatgtgagttcgccagtttggcttcgtcgtctagttcaagatcgttaaatttcttccggccaatcgctttttcctgatcttcggttgacaggtcgttccatgcgtcgagattatgctgatacttctgggcaaacgcataggagccattttcaaatgccgggtcttcatcgccaatgacggcatattccggcgtgtctaaggcgcttggattctcggtgccatcgacgaaaccgataatggcccgtccttcaaagtagcggaagccgtgggtctcatcgagggttaccgtattggcttcaataatggccataatctcgctcatgagttcgaacggtacggccgagttttgcgagcggatgtggaagaataaatcagccggtgttgcaacggctgtgtatttcggcccaacgatggattgaaaactttctaattcctttggtcgtgcggcttcgggaaaaagatagtcccatgccttgcgcgacaacccgaaagcgactgctaattttgcctcggggtaacgaatattcatgctgttgataaaagctggcagatgctccgccaagtcggcaatcattgccttgtcactagcggggtcttgtcgttttagatcaaacgtggcaaagataatgtctgagcctgcatccttgtaaacatcttgaacgtcccgtaaatcaatggtcatatttctgcctccaaactagaatcattctaacctagaaacagtttagcatagccgtgccggaatgcaatccttttcatcgccggttctgctaatatattagatgaaaaaacgcgatcgttgcatgcgactgttgatggctcacgtgaggtgttagaaggtgttgttatcagtgtggctggaaggcgtcatgagccgtatgtgttttaattgtaagctgtccttttacgtaattttcatcaaatcgacatagctaggtggtaaagtaatcataaaggttgtgatttttaacgatgacaatactgaatcaggttgaattagtcgtccggttgttggtcgcggcgttttgcggttttgccattggttatgaacgcaaaaaccgtttcaaaaacgccggcattcggacacatatgattgtggcgctaggttctgcgttgattatgatcgtatctaaatacggtttctttgatatcttaaatttgaaaaatatggcactggatccatcccgggtggcagcgcaaattgtcagtggggtcagttttctgggtgccggtgcgattttagtgcggcacaataatgtcaatggcttaaccacggctgctggtgtctggacgacggctgcagtggggatggcaatcggcgccaagctttatattatcggcttgtccgcaactgttttggttctgtgtattcaggtgttgctgcatcatcattatcggtggttaccaggtggcgataatggcattttgaccattcgcattcgtaatgaagggttcgatatggaacacatgcgacaaacactgggtaagtatcacattaaggtcctaaacgtttcgattaaacatgaaggtgatgaagtgaagatgacgttgcatgttgaaagtaaagccaatgaggatatgcgacgtttgttgatgttttatgcagataatcccaacattatttcaattgagttttaagctgtttaattgatctgactggttccatcgctgtaattgagggtgacgccaggctggacattgaagatatacacattaaagcgaatcgtgttatcgccaatactttgcgcccgcatggccacaccgcgggctaggcgttcatcgccgcgaaaaaccggggtgacttcatagcggacaaagtgttgaggggattgtttgagataatgcgcaatgtcatcttcatgtgcctgcattaaaggtgagttgagttgacgtgtgcctgtcatcagatttttgggattattattctcgccggataactgaaaaccgatcaaatgactgcggttatagagccattcaccatgaactttcttgttatgccagccagtcggattccaagtcaaaggctcgcgttttactttgggcatgatgctttggtttaaaagggcattcgcggtaccgacgcggtttaaagaatccaagtcgctaaaacgcgtccatggtccgttgctggtagtcagctcggattgcgtaaaaccgggatcattattgttgattgtgatttctggctgaccgttttcggtaagttgtgctaattgcttaaccggttgctgtgacgtgccggttttggcggttgatgtgctactactgctactactagttaaagctggcagccaattggtttgcgggtgttgttgcgtataagtgtaaccgccactcgcaatgccaactagcaaaagagtgattgcaagtttacggttggcgcggcgttggcgtttagtgccattgcgtaataacagcagcgttatgccagcaaggatcagcatcaatgtgactaagttgttcataggttcctccagatggcgattgtcgtggaaaagatatggtttgaggttaacacaagtctgactttgcggggcagggtgtttttcggtggatttggtaatttgttcattcgattattagattacgcaaaagaaaaggtaaaaagcgggtgacaccgtgtcaccgcttgaattcttaggttgtagatgttctggttcacactttaaaggtgtttataattgcaggtacctgcgtgtaaggaccttaagtgcgatggccaaagctctggtcgtcacgtctgaggccacttatgttctagtttatgctcataacgcgctcaccggcgcagggatctgcgtgtaaggaccttggtcgcaatggccaaaaaccggccatcacgtccaaggccgcttatgttctggtttatgcccataacgcgctcaccggcgcagggacctgcatgtaaggaccttggtcgcaatggccaaaaaccggccatcacgcccaaggccgcttacactccggtccctaagcgcgccggttcgcgctcacgctacatttgtgaattccctcaatatctgctaatatatgtagaaatcttttaagcgaggtatgaaattgctcacagtaaataatgtttcgatgacgttctcggatcggaaactttacgaagacgttaatttgaaatttacccctggcaattgctatggcattattggtgccaatggggcggggaaatcgacttttctcaagattcttgaaggcgaattaacaccgacaaccgggaccgtgagtttgtcaccgaatgagcggatgagtagcctgaagcaggatcactttgcctttgatgatcaaacggtgatgaatacggttttgcaagggtgggaacgcttgtatcaagtgatgaccgaaaaagatgccttgtatgccaagccggacttttctgaagcggatggtaataaggcagccgaactggaaggcgagtttgcggaaatggacggttggaatgccgaaagtgatgcctcgcagcttttgcagtcgttggggattagcgaaagtgaacaccagaagctcatggctgatttgcctgaaggtgagaaggtcaaagttttgctcgcccaagcgcttttcggtaagccggatgtgttgttgctggatgaaccgacaaacgggcttgatccgcaggcgattagttggctggaagactttttggctgactatgaacacaccgttttagtggtttcccatgaccggcatttcctgaatgcggtttgtaccatgatgtgtgatgttgattttggcaagattgaattgtatgtcggtaattatgacttctggaagcagagctcggaattggccttgcaactgcaaagtcaggccaatgccaaaaaagaagagcagattaaacagctgcaagaattcgttgcccgtttttcagcgaatgcgtctaaatccaagcaagccacatcgcgcaagaagcaacttgaaaaaattacattggacgatatccgtcccagttcgcgtaagtatccgtatatcaagtttgaacctgaacgcgccatcggtaacgacttattacgggtcgaaaatgtttccaaaacgattgatggccagccggtgttgcaaaatgtgagcttcattttgcgccccggtgacaaaaccggcattattagccgcaatgacgtgacggctaccgttttaatgcagttgctggctggcgaactggagccggatagcggaacgattatctggggtgtgacgaccagtcgagcctcgatgcctaaagacctgaatccggagtttgaccatccggaacttaatattttggattggttgcgtcagtttgccccgcaagaagaacaggacaacactttcctgcgcggttttctgggacggatgcttttctctggcgacgaggtactcaagcagcttaacgttttatctggcggcgaaaaggtacgctcatacctggccaaaatgatgttgagcaaggccaatgtgctcattatggacgatcccacgaatcatcttgatttggaaagtattacgagtctgaatgacgcgttgattgatttcactggctccttgatctttaccagtcacgatcatcaatttattcaaacgatcgctgaccatattattgaagtcgggccgctgggtgtagtcgaccgcgccgacacaagttacgacgaattcatgcaacacgaaactgcccaggcacaggtggcggcgatttatccggcatctgagcattaagcgaaattgttaatgaaaagcattgttgctcccgggtggagagacaatgctttttgttttttctgcaacggtgagggataatgtaagcaactttatccggtaaacgtctggtatcgctgcatcaaagggcaaaaggaaggaattcaacatgacacaaccagtcatgattttattaggtgttgggggtttcgttgttgcaattgtgctgctcaaccttatcttaacggggcaacgacaactgaggcttaaacgcgatctgattgcgaattggggcaagctgccggttaaacgtggtggcagtgagcgctatttaaaagcggcgtaccttgatcatgaagcgcaggttaaccatgattgtcagattgatgatttgacctggcaggatctcgatatgtttgacgtgtttaaacaattgaatgcgactcagagcagtgtcggtgccgagcgggtttatgcacaattgcgggcctatgatttaggcaaacccgatgtcaatgaaacgttgatcagctttttccagacccatgcagaagaacggctcaaagtgcagctggcatttgccggactgggagaagatgttgctaacaacagccagcattatttacgcaccacgactcagtccgctttgccgcatgcttggcggtttaaagtgttaggcagtttgccgctggtcggcttggtgctggcgctggtacttccggctattggggtgagcatcagcgtcttgagcttgatggtgaatcttttctattatgttttaaaacgtgaagccttggatgctgaagtaacggcgatgggctacttggtgcgaacgattgttaccgcggaacatttggttaaaattcagcagcccactcaggatgctttacgcgctgccgttcgaccgatgcgggggattagattacccggttggcgtttgtgtttcgctcgcgagataacagctcaagcgacatgatcaccgagtattttagcagcatgtttatgttgggctttattgcttataataatgtgttgacgcgcttatatcaccaccatgacgaggcattgactttgtggcaggcgttgggcgatttagagttagcgattgcgattgccaattttcggacggctcattcgcaaagcagccagccggcgtttgctgcaggcggcatgacggccacgggaatcatgcatccgctattgaaacacccagttgccaatccggtagcgtggaacaaaaatgccttgattaccggagccaacgcgtcagggaaatcgacatacgttaaaagcatagcggtgaatgccattttggcgcagacgattaatacggttttagctgaaaagttgacgatgcagccgggattggtgatgacagccatggcggttcgggatgatctcagtgaaggcgatagttattttgtcgcggaaattaaagcgattcaccggttgttaagggccgtggcgtcaaacaagcgggtatatgggtttattgacgagatcctaaaaggcaccaatacagtcgaacggattgcggcctcggccagtgtcatcaactggttaagccattatccaagtttggtcgtggtagccacgcacgacaatgaactaaccgacattatgggggatcagtgcatcaattggcattttcaggaaaaagtgacccaaaaagatggcgtcgtatttgattacttactgcatcaaggaccggccacttcccataatgcgattgcgttgttggcaacaatggcctatccggagccgctgattaaagatgcgcgtcaactcgccgcagatttcgaacgcaacaaagcatggcccaaatatcggcaaggagggattcaagcgtgacaacggccgacaagatttttgaagcaattcggcaggatccggctaatgcaacctttacggctcaaggttgggatccgttatatcacatcgaacctgacgcaacgattttgatcgcaagccaggcgccgggacgcaaagcccagacaaccaaaacctattggaatgatccaagtggtgatcgtctgcggacatggatgggcgttaccaaagatcagttttatcacagcggtaaaattgctgttttaccgttagacttttactacccgggaaaaggcaagtccggagatttgccgccgcgtaaagatttcgccgcaaaatggcatccgtccttgttagcattaatgcctcatattcagttgaccattgttattggcgcatacgctcagaaatattacttaggcaagcgccgggaaaagacgttaacggcaacggttaaaaactttcgcgcatacttaccgacgtattttccgattgtccatccctcgccacttaactatggttgggtcaatcgcaatccatggtttatggatgaagttgtgcctgctttacaggagcgagtggcacgactgatgaagtagggttcaactataacgtgttaaccgcgtgggttcgcgctcacaccataacgcgctcacagtcgcagcaatctctgtgtaagaacctctagcctaaatggccaaaaaccagccatttaggctagaggccacttacactccgattgctaagcgctcctgttcgcgctcaccaaaaaaccgccattcgtacttatcgacgaattggcggttttcttacgttgtgagtttctaaggataggttacggcaaaaccgtgaagatcaaagcaccaacgacgccgcctgccaagggtcctaatatcggtacccaagcataaggccagtcggaatcgcctttgtgtgcgattggcaaaatggcgtgggcgaggcgtggtcccaagtctcgtgccgggttaatggcataacccgtcgtcccgccaagcgataggccgatagcggtgattaagatgccgacgccgattggattcagtccgtctgtccattttcccttagtaaaggccaaaagtccaaagatcaagacagccgtgccgatgaattcggatatgaagttggccgcatagctgcgaatcgcggggccagttgcaaaaacgcctaacgttgtcgcaggatcgttggtcgcttcccagtgcggatagtaatgcaaccacacaactgccgctcccagtaaagcaccgagcatttgcgcaccgacaaatggcatgacccaagcccatggaaattgaccgatggcagcaaacgcaagcgtcacggccgggttaaggtgggctggaccgagaaatgccgcggcataaacgcccatcgtcacggctaagccccacccgagtgtgatggcaatccagccggcaccattcgctttggatttattcagcgatacgccggcaacgacaccatcgccaagcagtaccaggatgaaggtaccgatgaattcacctaatgtttgtgtccacatatggctacctctttctacgcaggattggttgatgctggcgtcttcttcaaatctgctaattggctttcacgaatggcctgattaagatctgccaattgttgggctttagtcgcgtcatcccaacccaataagcgtgccatttcatcaacgactggctgtttaagctcattaagggtctcggcatggaagagaattgcattggtccgccgcaataggtaatccactggtgtcaaggtcatttcctcgttgatcgaatagcgcaggctcatggtttccttaaggctgagtccaggagccgcctgcccatctgtgtaggtgacaacccggctgacatttgaaccgaagcgattggccaagtcggcggcatctttttccggcaagccggcatcgatgccaatccgcgtgtaaaaagcaatcgtatcgtcaacgttggtcgggtcaaaatgaccgcctgaaacctggagctttttggaatcaacggtccgtgtttcggttgcaaaatgctcagccaacaagcggcggatcaaagcaagcgcgcccgctgccatttttcgataatccgtgattttcccaccggacaaggtgatcatgccatcatcggcttggcgaagtgagctgccgcgggaaacctgtgatgggctcaaagcagcttcggcgtgggctgtttctagtttggagatcgcatgttcaacgtcagcgcgggtagcctggttgtcttcgtaatcatcaacgacacggattaacgcttcaaaggaatcatccgaaactttaccggtgttggcaccgccgccgttgtaatcggagctgccgttgttggcaatcagcggtcgcaatcctgcccagctcgcttcgatgtcgtctagcgtgatatggctttgcggatagcgcttgttgatgactttcaagagataatcgacatcggcttgttcgacttgcggatggttgaagtcgccatggtaatcggtatcggtggtgccgaagtaagtcttgccttcccgtgggaccacgaagaacatccggccgtcgttcaagccagtatccatatacgttggctgtggtaccggcagtcgagaaccatcgacaaccaagtgaacccctttcgttggccgcaatgttggggtttgatcttcggcttgatccaacgccttgaacttgtcagaccaaggtccggtcgtattgatcacgagtttggcatgaatatcgaaaacactgccatccaaaagatccttaacctgtaagccattaacctgaccgccatcatcatgcaaaacgccaatggcttgaacccgactggccatcagtccgcctaattctgccgcttctttgatgttttcaataacaagccgggcatcgttgttgacaaagtcgaggtacacgccgccttggaggccatcagcggctaaatgcggttcacgctgcagaatttcatctttggtgacggtgtagttggcgtattgggaaccttcaacgtttgccagacgatcatagagatccatggcgattttgatactgaacatatcaaaagtactgccggcttcctgataaatcggcaacaacatcgggaatggccgcggaatgtgaggcgcaattccttgaactacggcacgttctttaacggtatcggcgacaacgccgacatcaaacgtcttgaggtaacgaatgccgccatgaaccaatttggtcgagcgggaactagttccttccgcgaaatcctgcatttcaatcaagccggttttcaaaccgcttgcggctgcttgaatcgcaacgccggcaccggtgataccaccgccaacaatgagtaagtcgagttcggtctgcttcaattgatcaatcgtctgggtgcgggtttcttttgaaaatgccattttgagtaggctcctttttaaataagataaatgatggcgcaataagatcgtgctttagaatgaattagtcttgcttggtggtgtgtttgtactgctgggtggcggcaacggcttgtttccagccttcgtaaagtgattcccgatccgaaacgtccatggtcggttcaaagcgcttaccgaccttgacgatgctctggagttcatctgtgctgttccagaatccggttgctagcccggcaaagaaggcggcacccatggcagtggtctcaaggttggcggcgcgttcaatcggaataccaaggatgtcagcctgaaactgcatgaggtaatcgttattagcagccccgccatcaacgcgcagagctggaatcggcatgccggtatccttgttcatcgtgtcgacaacatcacgggattgataagcaagcgattgtaacgttgccttgatgaagtcttccctagttgttccacgggtaattccgaaaatagcgccacgtgcgtccgaatcccagtaaggagcacctaaaccagtaaaggcagggacgacatagacctcgttttgactcttggatgctagtgcggcagcttcggagtcgcttgaacgttcaatcagtttcatggcatcacgtaaccattgaatggcgctgccagccacaaagaccgaaccttccaaggcataagtgatcttaccgttgagtccgtagccaatggtggttagcagattatgattcgacaaggttggcttatcgccggtattcatgacgataaaggcaccggtgccatacgtgtttttgaccattcccggttcgatagccagctgtccgaataatgctgcttgctgatccccgaccataccggcaatgggaacggtactgccgaagaaatgataggctgctgcatccccataaatttctgaattgctgcgaacttccggcagcatttgcttggggatgttgagaatccgtaagatctcatcatcccaatccaacttgtggatattgaagagcatggttcgtgaagcattggtgtagtcggtgacatgaatggcaccgccagaaagcttccatgatagccaagtgtcaatggtgccaaaaagcagttcaccattttcggcccgttcctgcgcccctggtacatgatccagaatccagcgaattttggtagcagagaagtaggaatcaattagcaaaccggtggcatcgtgaaccagatcagcatagccatccgctttaagttgatctgcaatgtcgctggtttgacgggattgccagacaatggcgttgtaaatgggcagcccggtttgcttatcccacacgaccgttgtttcccgctgattcgtaatgccgatcccaacaatttggcgtggttgaatatgcgattcgataaacgctgtggcaatcgtggataacgcagcattccagatttcatttgcgttatgttcaacccaaccaggatgtggaaaatactgtggaaattcgcgctgggcatcagcaactttttgcccattgtgatcgatgatgatggtacgcgtgctggttgttccttcatcaatcgccagaatatactgctgttcgtttgtcacggttaactacctccagtaaaatatgattgcgcacaatgaaaacgttttctaaaatagttatacatgactttgctgctgattgcaagtagtacacttatatagataataagttattttaactataaggcgaatatttaaaagtgcgaatatatagaactagcccaaacccgcgggattacaggctcaaaaccagtttctcacctcaactagtccggctgaattaatttttttaattcaagaatacgttcaaatattcgagtttcctggcgccgatcagccggggaaaatcggtgcatcgtgctgtcgggacggttgactttggtgtagagaatggttgggttgtaggcatacatgccgggcgtatgggcaacgaagtcagcagtaaagtagtaatcttccgcaatttgtaatcgttcatcatatcgaatatgcccggcatttaagctggcacgagggaaagccttattccaaatataaccgccaatttcggtaccgtgatgcgagacctgttcaaacattgccgcttgtgatagcaattgaaattgatcggggccgccgcggttacgctgccaccagtcatagccgacagctgttgcgacaacgccgggggtaaatccgcgcagcaaggtcgcagcaaaagccggtgcaatcagatcatcaccatcgacaaacgcaagaaatagcccagtcgcatggtcaatgccaaaattgcgtgcggcgccgataccttggtgatgggaaaagacggttgcgtgataattggggatgccatttacaaacgcggcggcggtttcggcagtttcatcggttgaagcatcatcaattaaccaaagttccacatcgatggtttgttgctggatgctctttaaagtcgctggaagataccggcctaagttataggtggggacaataatggttaaatcaggaattgccatgatgacctccttgaaaaagatgtgccgttacgttcaatattttgtccggattgttaacagcttgctcattcgtctcgatcattatcgtctgatttaggaaggcgtcaattaaaatgcttggcgcctatcgctttattcttatatgaggacatgtatgttcatgttagaatagcttaaatcaggcgctttaaacgctttcgacaaaagatataaacatagcaatttctaagtgagagaattaagcctgaattattcaactttcaatcgttaagtacaagatccttgaaatgataaaaatctgacgtgaaatcaggttttccagacttttagaacagcatgctttagaagcgttattttttgcagtattgtccagaggaagattttttaatgactgagataccaaaactggtctgtgaaaaattcaggttaagaacacagcacagatagcaagtggagcctttcatggatcgatcaagtttgttattttaaaattatttattaatgagattttcgctagttataaggaaaataatgaatatcaataggtacttacttgttctaatattatgaaaaggttgacatttatgttattggtctataagataattaaaaatcgatgttaaagatagtgctcttgaaaagactgttgatgatgagacataattttgtcgaaacaaaaaagaaagcatttgcgtgggctggagttttgacgctcgctttttcagtaacaattctgccccttgctgatgttcaagctgctacagattcacagatcaatattgttaaaagaacttcgaatcaacaggtggaaaatggtcttaaccaacggcctgctcaattaatcacagatggtcttcctaatgcaaattatgggtatattaaaggtaataaatggtattttgctcaatacataagtccgagtgatgtcaaaacaatttctgaggcaggtaatctccctgactttttactagtagataatacgactaagtttggcatagacctttttatcaatgacttgataaaaacactgcatctatcaagttactttagtgggtatatgttatatagtgcaatcttcgcggattatttaactccattcaaaaaggctgctcaagaaggtcgaggaatttatattgttacagaggcagatatgaccaacccaactgctggctataactatgttgagtataggatagcgagttactaaccttattttgagtagagttgacaagggcttattactggctaaaagggcaaatactatgaaaagacttagacttataactgttaagagaatattgatatttgccgtcattggcgccattggttgcatagtaacagagctagtaaccaaaatagatcctaatgttgccagttatatttgggtgataggcttctttgtgacctttaaagttgcagataatgtctcaattaaagcaactgcaggtaaaggcagcaaacgttaaagtataattacttgacagggcctgacagatgtaattggaatgacgaacggagagtctccctaactgaatgataaataacggctgtgtcaacatagtcgttattttatttctatgaaaccttgttaggcaagcgtagttaattttaaaaaccattatgaaaagcattgcgagaatcaagtttaaagtaggtcctgaagaagttcaaataaaacgtttacattttgtttatatgtggtacaatttgtttgttgataggaatattcattgtggattgtgactattcaattaggcgagaccacaaatcatgacgctgagagtagcgcgtgatttgtggttttttctatgtctgggtgaggagatgatgagatgccgaaaatcgatcagatctttaacaataacgtggcgttggttgagctagacaaccatagtcaagcggttgttaagggacgggggatcgcgtttagaagcgtggcgatgtgattccggctaaacaaattgaaaaaattttctaccttgcaagtgaaacttcccgccagaatctgtactttttacttcgcaatattccgatcgacgtggtgacgaccacttatgaaattattgacgttgcgcaaaaacaatttcaccttaaggtacttgactatatttacattacgttaagcgatcatatttacgaagcctataaacgttatcagaatggaacgtatcaagagacgatggtgccggattttcatattcagtatcctgcagagtatgccgtagctaaccaagcgttgcagatcattgcagctaaccttggcgtagcatttccaccttccgaagtgaaaaatcttgccttacattttatcaatgccagcggtgaagacgacaacgagcaggcctttgacaagaataatgaggcgtcattaagtcaactggtgcaacgtgttttgaagcggcatcgcattacgagatcgcaaactaacggcaattattatgatcgcttcatgattcacttacagtatctgattgaccgactgcagcgtgttaatacggatgctgttgccattgtgcccgaggtggccaatgaattagagctaaattatccgcggtcttatcagattgcttcggaaatttttgatgagattaaggatcagctttatcgcaacatgagtgaagacgaacgcttatactttatcattcatattcaacggctaattaacgaagcgcctgcccacgatcaaaaacagggcaaaaaatcataacgcgtttgctggcttggagggcagcatacgctcacgggaggaaagtatcatgaataaggttttcgataagctaaagccgatttttgaagcgattgcggcgaataagtatgtgtccgcaatccgtgatggctttattgcctgtatgccgatcatcatcttctccagtatcttcatgatgatcgcttatgttcctaatgcttgggggttttactggcctaagaacgtgaccgataccctgatgattgcttacaactactcaatggggttgttggcattatttgttgccggtacgactgcaaagaatttaaccgacagcaagaatctggaattacccaagacaaatcagatcaatccggttgcggtcattgtcgcttcggaaatcgcctttgtcattttatcgattttgccgcttaaaaccggagtggatttaacctacatgggcacccaaggcttgatctgcgcttatatcgtcggcttaattgtgcctaatatttactacgtttgtattaaaaacaacgtcacgattaagttgccgccacaggttccaggcaatatctcccagtcatttaaagatttaattccaatggggctatctgttagtgctttttggctctttggcgttgggtttaaagcagcaacgggaacgatcctgccgcgctggattattcaagtattgtcaccactcttccaggccagcgattcttatctggggttggcgctgattgccggcgcgatggcgttcttctggttctgtggggttcaggggccttcaattgtccagccggctgttgttccgatcatgattgccaatacggcggccaatctccagcaatatcaagctggacagcatgtttcacatgtgttggcaatgaacacgatggattatgttatgaactttggcggtacgggatcgactctggttgtcgcattcgtgatgctgtttgcggcgcgttcggcacaattaaaagcagtcgggaaagcggcttttatcccgggaacattttctgttaacgagccggtacttttcgggatgccgattattatgaatccgatgtttttcattccgtttttggcaacgccgatcgtgaatgtttgcctgtttaagttctttgtcagtgtgttaggcatgaatagcatgatctacaccatgccgtggacggtaccggcaccaatcgggatcttagtttcaaccggttttgctccactggcatttgtctttgtattgttgacacttgtgttagacgtccttatctacttcccgtttattcgcgtgtacgatcgaacgcttttagccgaagaaaaagctaaagaagatgtgattgaaggacaggatacggcggttttggctgccgatacggttgcaccacaaacggctgaggttcaggtcgaagcatccgaaatggctgatgaaaaaccagcggcagcgcatgatgagagtttcttcaaaaataatgaaattgacgttcttgtgctttgtgccggtggtggaaccagtggcatcttagccaatgcgctaaacaagctgtctaaggagcgggggttgaagttgtccgccgcggctcgggcttatggacaggatatggacttgatcaaagatatgagtatggtcattctggcgccacaaatggaaagtatgaaggataatttgaaaaagattaccgataaatatggcgttaagttggttacaaccactggccgccagtacattgaactgacaaacaacggcgatatggcactggattttgttgagtccaatctttaggtgttcatcaacttagacagactcgtctgcatactttataggaggaagttcaaacatgcgtaaacaattacccaaggactttgtaatcggtggcgcaactgctgcttaccaagttgaaggggcaaccaaagaagacggaaaaggtcgagttctttgggatgattttctggaaaaacaagggcggtttagtcctgaccccgccgctgatttttatcatcgctatgatgaggatttggcgttagcagaagcatatggtcatcaagtaatacggctttcaattgcctggtcgcgaatttttccggatggtgccggggcggtggaacctcgtggcgttgctttctatcatcggctctttgctgcctgtgccaagcatcatcttatcccgtttgtaacgttgcatcattttgatacaccagaacggttacacgcgattggtgactggctgagtcaagaaatgctggaagattttgtcgagtacgcgcggttttgcttcgaggaatttccggaaatcaaacactggattacgatcaatgaaccaacgtccatggcagtgcaacaatatacgagcggcacttttcccccagcggaaaccggtcattttgataaaacatttcaggccgaacataatcaaatcgttgcccatgcgcgtattgttaatttgtacaagtcgatggggctagatggtgaaatcggtatcgtgcatgccttgcagacaccttatccatatagtgattcgtcggaagattagcatgccgctgatttacaggatgcgttggaaaatcggctgtatttagatggcacactggcaggagattacgcccctaagaccttggctttgatcaaagaaattctggcagcaaatcaacaaccgatgtttaagcgtaccgacgaagagatggcggctattaagaaggcggcacaccagcttgattttgttggagttaacaactacttcagcaaatggctgcgcgcttatcacggcaagtcggaaacgattcataatggtgatggctcaaagggatcgtcagttgcccgccttcacggtatcggtgaagagaagaaaccggccgggattgagacaacggattgggactggtccatctatccgcgtggtatgtatgacatgttgatgcggattcatcgagattatccgttagtaccagccatctatgtcaccgaaaacggtattggattgaaagaatccttaccagcagaagtgacgccaaatacggtcatcgcggatcccaaacgcattgattatttgaaaaaatatttaagtgccattgcagatgcgattcaggctggcgcgaatgtaaaaggctactttgtctggtcactgcaggatcagttttcctggacaaatggttatagcaaacggtacggattgtttttcgtcgactttccgacgcaaaaacgttatgtcaagcaaagtgccgaatggttaaaacaagttagccaaacgcatgtgattcccgaataagcgcaccggctcgcgctcacattaacgcgctccccggcgcaggaatctgcgtgtaaggacctcgaacgcactggccaagagcgggccatttcgcccgaggccgcttacactccgatccctacccgcgccggcccgcgctcatattaacgcgctccccggcgcaggaatctgcgtgtaaggacctgggtcgcaatggccaaagagcggccatcacgcccaggccgcttacactccgatccctaagcgcgccggctcgcgctcacttttttaaaatggaggttgaattatggcgacgagagaagagatttcgatggttgggtttgcacttgtggcttatgcaggagatgctcggactgcggctttgcgtgctttgaatgctgcagaagcgggtgactttgaaggagccgaggccaaacttgacgaagcgcaaaaagatattaatgaagcgcataatcaacagacgcaattgttaagccaagaagcaggcggagcggaaatggatgtgacttttatcatggtgcatgggcaagatacgttaatgaccaccatgctgcttattgatcagtctcgttacatgattcgaatgcttaaacgtatcaagcaactcgaagacaagcaataagctaaaacccaacacccgcgctcttcttgtggtaaaactgaccaagtgatagcgtctgatttggtaaacatgttgccatacggattaaacagcaaaagcatcggattattgtaggtgagataatctgatgttttttgtatatagtgacgatgtttctgcattttttactaaaacatcagcaaacaaatcagcggagttttggaagcttatttacgagctgaaaaaatattcgacaatagcgcttccattttggggttaattttagtaaaataaaaacggttacaaaaatcgacaaataattgacgcgtttttaaatattaggaggtattggcagtgaacagtacagatgtcacgaaaggctttacggagcaatttggcaagcaagcagaacacacttttttcgcgcccgggcgaattaatttgattggtgagcacacggattacaatggcgggcacgttttcccttgtgcgatttcgcttgggacgtatgcagcggttggggcaaatgatgacaatgcgttccgtttgtattcggccaatttccctaaagtgggtattattgacattccgttccctgatcttttccaggacaagcgcggtttgtggacggattatttccagggaatggcgcgggtcatgaaaacagcaggtatcaattatacgcatggcttaaatgtttatatcaacggtaacttaccggatggtgccgggctatcaagttctgcttctctggaaatgctggtaggcacgattttgaacaacttattcgatggtagttttgcaccgctggacttggttaagttcggggttaaagtcgaaaatgattatattggcgtcaattccgggatcatggatcagtttgcgatcgaaatgggacgggcaaaccaggcaactttgctggataccaacaccatgaagtatgaatatttgccggtagaaatgggcgacaatgtgattgtcatcatgaataccaacaagcggcgtgaattaaccgattctaaatataacgaacggcgcagcgaatgtgagaaagccttggcgatgttgcaaaaaggcattgatgtcaagagtcttgggcagctaacggaagatgaatttgatgaaaatacttatttgatctacgacgagacattgattaagcgtgcccggcatgcggtatttgaaaatcaacgtacgttaacggctgctaaagcactgcagtcaggagatcttaaaacctttggcaaattagtttctgcgtcaggcgtctccttggcttttgattatgaagtgaccggaattgagttggacaccttggttaccaatgctttgaagcaacgtggtgtgttgggggcgcgcatgactggtgccggttttggcggttgtgctatcgctattgtcaacagtgcagacgttgaggactttattagtaacgttggtaaagcttatactgaaaagatcgggtatgacgctcacttttacgtagcggacattgccgatggtgctaagcaattggattgaggcaaaaaggccaaatgttcggcttaagtaaacgcatcacaaacattcaaaggagcgatttttaatatgacgattgcagttttaggcggcgcggggtacatcggttcacacacagttaagcagttactggcagatggagaagatgtcatcgtcttggataatctgattaccggtcatcgtaaggcggttgatccacgtgcccggttttatcaaggggacattcgcgattaccattttttgagtcaggtttttagccaggaaaagattgacgggattgtgcactttgcggcattttcgattgtaccggagtcgatgaaagatccgctgaagtattttgacaataacacaggtggcatgattaccttgcttgaagccatgaatcagtttggcatcaagaagattgtcttctcatcaaccgctgccacgtacggcgaacctaaacaagtgccgatcaaggaaaccgatccgcaagtgccaactaacccgtatggtgaaagtaagctggccatggaaaagatcatgcattgggctgacattgcttatggtttgaagtttgttgctttgcgttactttaatgtggctggggcaatgccagatgggtccattggtgaagaccatcatccggaaacccacttgattccgattatcttgcaggtggctgcaggtacccgcacaggcttgcagatttacggtgatgattacccaaccaaggatggtaccaatgtgcgcgattatgtgcatgttgttgatttggccgacgcacatgttttggcactgaaatatttgaatgccggcaatccgtcatctgcatttaatattggctctgctcatggcttttcaaacatggaaattctcaatgctgcgcgtaaagttaccggtcaaaagattccggcaacggttggtccgcggcgtgccggtgatcctagcactttggttgccagttcagagaaggctcgcgatattctgggatggaagccaaactacgatgacattgataaaattatcgaaacggcttggaactggcatgaaaatcatccggaaggcttcggtgaccgtaattgacggcaattagcaatcacattgagaccattatcaagctgaatcctgattacacgcagatggattcggtttatttaaccaataagttgcttaatttaatcggtgatgcggcgcttgaactgccaggtgatccggacccgctgaataatctggatttaatggtcaaagccgcgcaaacgaacggtaaaattgcggattcacaggctgcacgccaaatccttgaagcccaattaatggattttgccacgccaacgccaagccggatcaatcagttgttctgggataaatatcaggcaggaccgcgtgcagccacagattggttcttcgcgctaagtcgagcaaacaattatattcaaacgcgggccattgctaaaaatctggtctttcctgcaaaaaccgagtatggcgatcttgaaatcacgatcaacctatccaaaccggaaaaggatcctaaagatattgccgccgctgcccatgcgcaatcgggttatccggcgtgtgcactttgcttgcagacagaagggtatgctggccgaagtaattttgccgcacgtactaaccaccggattatccgtttcttgttaggcggtaaaacctggggctttcaatattcgccttatgcgtattttaatgaacatgcgatctttttggacgctattcacgagcccatggtgattgaccaaagtacttttaccaacttgctcgacattgttgccatgtttccagactattttgttgggtcaaacgcggatctgccaattgtcggcggctcgatgcttgctcatgagcattatcaaggtggacggcacacatttccgatggcgaaagcgccgatcgaaacgcaaattgagatcagtgggcatccgcatgtttttgccggcattgtgaaatggccgatgagtgtgattcggctggtcagtgccgaccgcgaagaattgatcaatgcggctgaacacatccggcaggtttggaatcagtatactgacgaagcggttaatgttcgtgcttttgtggagggtaagccgcatcatacggtgacgccaatcgcccggcgcgtggggtcagagtatcaactggatctggttttgcgggataatcaaacgagcgaacagtatccggatggtattttccacccgcatcaggatgttcaacatattaagaaagaaaacattggcttaattgaagtcatgggtcgggcgattttgccagcgcggcttaagtctgaattagcagaagttaagaagtatctcttaggcgaggctaatgagatgaagccaatgcataagacttgggcagatcagctgaaagtggcttacaattggacaccggaaaatgcggaaagtcagttgcaagaagcagtcggaaaagtcttcgcccgggtattggaagatgccggcgtctttaaacgtgacaagatcgggcaagaggcatttggccgcttctgtcgctcgctatagttgctggttattgttaatggtcagggaaacggagggaatcgatgaccacgattacggatattgcgaaggcggcgggggtgtcgatcgctacagtttcgcggattttgaattatgacgctacactggcagtaacgccggaaacacgccaacgggttctaaaaacagccgagaagttagcgtataaaccccgtcgccgcaaacgcgttgctactcaaacaacggtggctctgattcagtggcggagtgaacaagaggagcttaatgacctctattatctgcagattcagtacgctattgaagccagggccgcatccattggttatcatgtgcaaaatctgcacctggagcaattaaacgcggaaagtgttgcaaatgttcagggtatcattgcacttggcaagtacgatgcaggtgaggttgccgaaattaaggcgttagggttgccgattgtgtttgttgatcagaatatgctggcgtttgattgcgattccgttaccggcgattatgctggcccaattgcccagatcattgatcattttcagaaggtcggcattgatgatattggttttcttggcggattggaaacgagccgcagtggacgcgaacagtttcaggatgttcggaccgcgacatttgatcgtgtgactaaagctgccggaatcgatcatgccgagtttcgattgatcggtgaatttaccccggattccggttatcggttaatgcgacaggccatcgaaaaactaggtgagcggttgccacacgcatttatcattgctaatgacaccatggcggtgggtgctttgcgggcgcttaatgaagctaacatttcggtaccgcagcgtgtttcggtcatcagttttaatgatgttgccgtggctaagtttacaacgcccccgttatcgactgtgcatgcagcgaccgatcagatgggtcaaactgcagttgagttgctacaggcgcgcttgaatgatgctaaacgggttccacgacaggttaatttcaaaagcgagttgattatgcgcgccagcagtttgtaggtggcaccagctgtcagatgataccgcaagatggctgtacacaatccgggaaccatgacataaggaggttatgatggacgtttcagttgagcaatatggtcagtatcagggacaaaatctttatgaattaaccctcaccaacgaccaaggtatggtagtaaagctgttaaattatggtgcaacgttggagaaggtgcttttaccggaagcagatggtctccacaacatggtgctgtcattaccaacacgcgaagattattcaaaagaacgtaattttcttggcggtacggttggccggattgtcgggcgaattcggggccacgtttggcaacacggtgacgttaaagtcgatttgccgatgaatgaaggcaagaaccatattcatggcggagatgatgggcttgatcgtcaagtttacaattttcgcaccgagcaaactgcaacgacggcgagtgcgagctttacttttgtcgatccggccggacacaacggttatcccggcaatcttaaattacaggtgacttacacgctgacaaacgcgaatgctttgcaatatcgcgttgatgcattgagtgatgatgagacgctgtttaatccaaccaaccatacttattttgcactggatcaaccagctacgattgatgaaaccgtactgacaattccagcagatacctataagcccttggacgccgaacatcttccggatcaaggctggcaaccggtggcgggtactgtattggattttcgcaacgggcaaaaactgggcgatgtcatccatacgcgtgccgatcaaattacatctgaacgtggcattaatcacccgttcctcctaaaaaacggcaaagcactagccgccaagctgcaaactaaaaatcacacgatgacacttgtcaccactgcaccaagcgtggttgtgtatacagccaatcatttcgatggtacaggcgttgcgcataacatcaagcaatttgatggggtagcacttgaatgccagtatccgccagtaagcggttcggatttatccgcgatcacgttgctgccaggtgaaccatttaccttggcgaatacttggacgtttgaataatagttaacgacgaaaggctctttggggatgctcaaagggcttttttgtatgctggggtatcggtgctggctttctgcttgttgaagcatgggtgttgtggtgttagggaatcgaaaagattgagtttatgcaaaccgttatattttgcagcgggtttatcctgatatatacttttaggaaatgaaagcgattacgatagcaagcttttaaattaaatattctcgtgaactaatatttaaccgctgtgattaaagatgcagcatgaaagtggggggttcgctatgaaaaacggcttcttgaaattgccactcagtgtacagggaatcgtcataatggttgtctggttggcagttaacgcgatttatatttggtacaactggccggttaataagtttgattttgcgccagcttttttaccggtgtttcctgttttgatcagttccagaagcggtgtcgtcatcactaattggcaaccgtgtatggcaattattgttggattgacgagttggtatctcatcaggcaaacgcgaatgcaaaagacaaaatcgccgctatttattcgcttgatacgtcacctgttaccggtttggctgtttatggggacttgttttttattattgaatcattcattaacctttcaattactgacttagggtgggcgccgttagcaacgattacttggggttcaccgtatacattattcttcttggcaattctggttattgttaatttgattttactgttcctgaatcgaaccaacacattagatgtcgatatttttgatatctggcatttgtcatttacaggtctattggctatttattttggtgctaacctttttgttgctaccgtgttggttatcttcattggcgttttaaaaattatcaattccgatttgatgaagccgactttcaatgacttgttggacgactgggagaacccgatgacgacaacgcatttaaactacatgatgaatcctgtgatcatggtgtttgataagttgtttgacaaattgttcccatggttggataaatatgacttcgatgcggcaaagctaaatgaaaagatcggattctggggcagtcgttttgccattgggatttatctggggatctttatcggtctgatttcccatcaagatattaagtccattacgacgctggcctttatggctgcgacctgcttggagctgtttagtattattggttcgtggtttatcgcagcggttgagccgctatctcaaggggttgcggattttgctaacaaacgcttaggcggccggatgcttaatatcggacttgactggccattcttggctggtcgtgctgaaatttgggctgcagctaacgttttagcaccaatcatgttgctggaagctttggtattgcctggtaacgggatcttgcctttaggtgggatcattgcaatgggtgttaccccagcgctgttggtggttacgcgtggtaagattattcgaatgattgttattggtgctatcgaactgccactgttcttgtgggccggtacactttcagcaccattcattacccacacggcacgtgctttacatgcgagtggtattcctgccactgggttaatctcttcgtcaaccaaggaaggcccgattgaacagttcattgctgttttggttggtaaagcttctaagggcgaaatgatgatgattgtgtatgctgcgttggcattaattgcttacactgcattgttcttctggtatcgtcatgaaatgatgaaacggaatcagaagtactctgatgagggtaaagaggttgctgatgatgttaaatttgtcgcaacccatgccgctgctaattcagcagattaatgatgaagcatttaaaccattctgttaggtatcattgatggtgattgtgctataaacagctctagacgatgcggtctagggctgttttgctataaaagctttaaaataatttggcatataaatattcgtaaaccgggtgtatagtaaaaatcaaccaattcgaattttggaatcctaaaatggtgagggcgtggagatacttgcagagactagcatttctcaaatcatggcttgtttttatttgtgtcggactagtgggcgctgagttgacggaacttgctactaagattgatcttaatgtggcagcctatatccgcctaatcggttacttactaacgcttaaggtcgctgatgtgataacaaagaaagttgagtccaataagaagactaaacctcgccaaaattgagcatggatggatgcatgctgaaatgataccagtaatggaatagcttgaaggtcaatactaacgcgtggctggcggccagcttgagtgttcaagcaacagagagaaaaagacggacagatttcgagttgaaatctgtccgtctttttgaggggtggatgatagttcatagtggcatatcattatcgacaagttttagttcgtggatttttgattcatccgatgtgctcgccgttttttacgatcaaaaacgttgtcaattttgagtaactgataaagtgcatagcaagcagttaccatgaccgctacctgggtgaatgtattcttgaaaatgccgtttaaaatggtgacaagtgtgacgatgccgagccaaattaggtaactttttttacgatttgtcatcaaaaaggacctccattaatcttatcctacctctattatagcttaattgaagcgctaaaactagacaaaatgaacgataacaaacaaaaaagaacatacatgagcacgtttcgcgttgacatcgcataaaatgaagggcgatagtggtttactaatcgagaccagtaaacggctttcgtccttcgcgtctaatatgaatcttccgtacattgtttaataaatcggaagttttaagttgactttagcagtcaaagtttaacggcagcagtgtaaattcgcttaaagaattgatccatggttgcttgaggcttaagtacattggtcaaaccgacaacagctttcttttgtgcttgattaatgcccagcaggccagtgtagcctagaacgctgccgctgttaccgagccatccgtctgccagcttgtaccagccatagccgtatccagcttcggcggctttaaagatcgtcttccaactggccgcggttagtagttgacctgtcaaaactgcttgggcaaatttttctaagtcggcaaccgttgtgacgagtccgcgatcggcttggttttcattacctttaccagccacattgggattgccggctatccaatgataactttctgcaaatgcgtgggctgtgccaagtttcgtattggttaagttcagcggatcatagatttgtgcttttaagatcgcctcaagtggccgttcattcgtcacgcgatctagaacttcgcccaacagcagtgcgttcgtgctgctgtacgcggttttgctgccgggtttaaagttcaggggtagatcatcaaccacagccagtaccttggctaaatccatgttttgactggtatgttgattgatttgcagcgctaaccgttcggccggcagtgtgtcgggagcgttggctttaaatggtgcagccatcaaagttagataatctggaattccgctttgcatggtggctagttgcgctaaggttatttgctcggcctgttgatactccggaatatacttagacagtttgtcagttagcttgacggtgccggcttcaacaaactgcatgagcaaaacaccgaagaactgttgggtgacagttccggcaccgcttattgtatgggatgcaaacggtaccttcatgtcaatatgggaaaacccctgcgcgtctgctgctaattctttatcgggggaaacaactgctacagcaccgttatagtgttcggtttgtaaggaacgactcaacggtgattcatctttaagaacttctggtgttaccattttgatgcctccaagcaagattgacttggtcgaactttagctgtgttatctgaaacgtggcgttttcggccgttttggttgtgttttaatctaggtgattgacagtgactagcttgccagtaacgccgactttgatgccttgattgatcttgtcggtgcggctggcatgaacgacttggaacttgttttgcttaacaatcaatgggttgtcggtgtgatagccgactggtaacggttgattgctaccgcgaattaacatgacaataaatttaaatccgcttgcatgagcctcacagggactgtaatgcaaagtgtcactgaagaattcgaccacagtgccagcagggacgaagaatagcttagcgtccttttccgcgttaaattgaccatcatgcatctgcccgcgtttaccgatcaccatcacgacatcggtgaagaaaacattcacctcgctgccttggtgaaattcgactgctgtcaaagcctcggcgtgtccggcacattcaccggcttcgattggcagaccggcaaaaacatcacgaccaatctgttggaccaccgggagcttttccattgcggggttggaaggaatatagcgattggcagcagtcggagcggggatggggacttgctgatccatgaactgttggagttcgctgacgtcatactgtgtacaggtgaccccgtaatcggaaaacgctgaatcggttaactgatagatcgtcttatccggattcagagcttgaatcttttcgaaagttgacatttgattgcttctttcctggtttaataagtttcaatggtgactttagcaaaatactcggcaaacttggcggggttgacaaaaccggtttctgcttccatggtgttgagcatgccggttgtcattgcggttttcataatgtcttcatcggacttgccatcatgaatgccaattgccagaccggcaagtgttgagtcccctgagccaacgggattgacaacctgaatcttaggaatcgcggcgtggtagaacttatcttgatgtttaacaaaagcaccggctgaccctaatgaaacaacgatccaatctacgccgtcaaaaatcggatcagtgagagcttgtttcaaggttgcgtaatcagtcttatccaccgaacgattgagcaggccggcgagttcctcttcattaggcttgattaacagcggctttacgggtgcttcaagggctgatttcaaggttgcaccggatgtgtctagcagcaccttcacgtttttggcaccggcatgggcgatcatttgcgtgtagtaatcttcaggaagtccttgtggcattgagccggaaatcgtcaacaaatcggtctgatcaagtagcttatcaaagtggtctaggaaggcacttgcatcttcaggcgcgatggttgggcctgcttcgagaatttcagtttgtttgccgccatcgtgcaataccgcaatcgagctgcgggtttcggcgtcaatgggaaagaagttatgggcaatgccatcgtgatccaactgattttccagccatttgccaaaataaccgccgatgaagccagtggccgtgatgtcatgatcaagcagatgaatgacgcgggaaacgtttaacccttttccaccagcagttttgcgaacggttttaacccgattgaccgtgtcgattttaagatgatcgagtggataggaaacgtcgattgagggatttaatgtaaccgttaagatcataatgagttttcctccaaaagtgaacgtgagcaggttgcctgctaacgtcatattagtgattgtgttagtcggttttcggttaataaaagccgacccctcaaggaatcggcttttatggtcttacacgaactattcgtggctgaccttgtccgtccaaggagtagcagtatccgctaaaaccttgttcaaacgatcgatgttagctttacctttcgtttccagccattgcttgccggcagcttcgccttcagcagcaaatggcttaacgcctggcttccaggttgcccggccgcaaagcacaccgttaaaggttgaaccggattccttagcgaatttgagttcttcaaggaacaattcgttggaaacaccagcggacaagaagatgaacggcaagccggttgcatcggactgggctttgtaatatttggcagcttcttctttggtataaaccggggttacgccttcatcggtgaagccttcaacaaacttctgatcaaccggaacttcgacttttagaacggagacattgtactgcggtttgctgaattccttggtgatcttgatgaccttgtccggcttaaccttagcccatgcggcggtgccagtctcgttgagcgtaccatcataggaaaccagttccaggaacagtggtaaatcattagccttagcttcagcaccaacccgctcaacaaacgcatatttacgatcgttgatactatcaggttcgtcagggtcaatgtatagcaggaatttgactgcatcgccgccttcgttcttgatgcgcaaagcactttggttatcaatcagatctgggaaacggccaggttcagtcgcatcgtagccggtcttttcataggagagaagcaagccggcttgtggtgcacgaactttggcagctggcaggccatattccggatcaagcaaaattgaactggcgtatttggttagttcttcagaaaccgctttcttgaaatcgacaatggtggtttcatcagctggcttgttcgctgcagctgcaagcattttctttaaagaaccgcgttgatcaatggccagcgcggagataacgttattttcgtcggaaagtttttgcagatgcttgaattggcccgcagtaagggtgactgtcatgtaaaaaatgcctcctaggattttaatgtttaattagtcgtgatagacgccttcagcccacttttcgagttcagcatcaaagaaatgcgggttgtctttttgatcaggatttggtttcgcgatgttgtcgatcttatcaatcaactttttattttcaggcgtttctttgtaggtggcatccagataagctttgacaatatcttgaatgaggtgaacgccgacaactgcgccaccgatacctaagacgttagcgtttagctgttcgcgagcatagacggctgaggtgacatcatcacacatggccgcgcggatgccttcgtttttatctgcggctgttgaaataccgatacctgtaccgcacatcacgataccgagatctgcacgaccatcagcaacatcttcggcgactttcttaccataaatcggatagtgggtacgatgcgtgtcataggtgccttcatcaataactgtgtaacccatgtcttttaacatgtttgaaatttcaatcttttgcatcgtgacgatgtgatcgttaccaatagcaataatcataagtgtgaagcttcctttctatattgggtgaaagacggcgttaaatcattttttcaagcatgtcgagccggatttgatgacggccgccagcatattcggtatccagataacgttggatgatgaccagtgcgcgatcataacctgtaatgccggtaccgatagcaattgccttggcgccattatgttcagccgtcatgtgggcagtgttttcttcttcaacgaccgcggtaaccatgcctttgactttgttagaagccatggcagaaccgacaccgtaacgatcaaacatgatggctttgtgcgcatcactgtttagcagctttttggtaactgccagtgaagattcaacaaaatcttcagctggttcaggcgtcacatccgcgacccgatattgatgttcctccaaatatttcttaacttgttctttcattgcaaagccatctttgtctgcaccaataatgacatccatgatctattctcctttttttgttttgtctgtaataacatgcgtatatgtgttgtaatgttgccgatcgtcagcgctgattccgggatcagtgataagcccgtctgtttggtcaagatcgtagaaactgtagaaatcttgccgattaagtttgaaatgatccgcagcaacaaatttcatccccgcattgttcaacgcaattcgctgcgtttgaccttcttcggggctggcgttgctaatgtgattgtcagcgataccgttaacactgatgaatgctttggtcgttgtgaggtgagctaacatctcatttgccaagcttccgataaaggctcctgatcgttcgcggagctggccgccgatcagttttaacgagaagtaatcggcgcggtcctgaaagctttggaagacgggaagactattggtgatgatccggacgtcaggtttcttgaggtactgtgcaatcagttcatttgttgtgccgggcccgatataaatcgtatcgcctgaagtgatgatatcagcaatggtagcggcgattttacgcttttcgttgacgtgaatggaccgcttctcatttctggacaattcagttagcggtttaaaatgggtactttgtgcgccgccgtgaatacggactaactcatttctttcagcaagctcttccagatcccgtcgcacagtcatggttgaaacgcctaaactttcaccaatttcgttaacggtcacaatccctttacgatcaactaaattacggattgttagcaagcgctcgtcttttaacattgactcacctcacaaaaaaatgttcgttgttgtttgattttgtttcttattacagtccttaagttaccactggccacatgattcgtcaagaccatagttgcggtgtttacgactatttttatcgcgtgtttttataaaaaaagaaataaaaagcgtcataaaaatatgcagatatagccgcatattagtaatcgaataaacagaagacaacaggtacacacagaaatacggtgcctgccaaatatcggttgatgatttcacggattcaaacgactgattcatttagcgtcaattgaccaagaacggaactcaagaagcgcaaaaaagccccaaacatttgcatgcttaggactgtggttacgttgttatctggtagaattaattggtaataacttgactattaggggcagtgtcactgttaaaacgcgtaatatatagtagcagtcatacgttaattaagctttgaaagttttaataaatcatccgcttgctggaggacagcaatgcgtggcgtgacagcgggtgatggtggcgttgtccaccccgcgagtgcaaaggcaacttttgcatcggctgcggcttgggcgtcagtcggcgtatcaccgatgtaaaccgtcgtgtcaggttggccgcctaaccggttacgtgctaaggtaattggatcgccaaagggtttgttgcgtttggcttcaccggcgacaaccactgtttcaaaatacggactaaagtgatacttcttatcttcttcgaggaattgcggtttgtcttttgaagtgacgagaccaagcttatagtggcggcttaattgcgttaggactttttgcatgttggggaaccaagtgacatggttgagaaaagctttcgagtcttcgcgccattcttcatgcaccacgggaatttctgctggaccgaagcctagctcttttaaactatcgacaccagcgcggccattggtccaagtcaagtcctcaatggcgattttgcggccatggcggcgtaaagttttttgaagcccgtaaaggtaaccttcaacgttgtcaagcaaggtgccgtcaatatcaaagataaacgtattcatattcttcctcctataacgcttattattgtaacaagtaagcgataacaaagaaaggcgtaaacatgcgatttctacacacggccgattggcatattggcaaaaaactaaacgattttgacttattggaagatcagcaggcggtgtttgaacaattggtgaccgttgccaagcagcaacaagtcgatgctattgtcattgccggcgatttatatgaccgcgctttacccagtgaggccgcggtggcaacgcttgatcatatgctggtaacgctaaatcgtaagctgaattatccattgttggtgatttccggcaatcacgactcggctgtccgcctacgtactggccggtcatggttttccacaactaagatgtacgtcaacacgcaattagccgaggcatttaccccagttgaacttggtgacactcaatttttcttactaccttattttgaaccgtttgctgtccgtgattattttcaggatgcaacgattaccaatgtagcacaggccattcgcccgattgttgccaaaatgaaagcccagtttaaacccgatatgcggcatattttggtgagccatttttttgctgccggtagcgatcatagcgcttcggaaacaaaggttaacgtcggcggattggatgcagtcccgattgatgacttggcagcgtttgactatgtggcgttaggtcatttgcataatcataatgcgctgcacgccgaacctaagattcagtatagtggtgccttattgaaatatgcggtcgctgaagccaagcaggaaaagggcgtctacattgtcgatactgacacgatggcgcggacgtttattccgttgacgccacaacatgacttgattgagttgaaagccagctatgcggaattgactgatccggatttttatcgccagcaggaccgcgatgcttatattggcgttgatttaaccgacacgcaggtgattccgaatgtcatggcccagttgcggaagatttacccaaggattatcagcctgcgccgtgaaaatggggtcaccgccgtaaaaccgttaaaacaacggcagcgcgatctcgatccgctgagtttgttgaagaatttttatgctgagatgatgcaaacagatctgacagcggatcagctgaagtgggccaaagcgggacttggtgaagcagaaagcgggcagaaacagtgaaacttaaacaattacacatgcagtttttcggaccctatgcagatgaaacagttaattttgaagattttcgcacgaccccgctattcttaatcagcggaccgactggcagcgggaaaaccacgatttttgatgccttagtgtatgcgttatacggcgagacgtcaggggaacgcgatggcatgcagatgcggtccaactttgccagccaccatgatctgactaaaattacgttaacttttgatcatgacggtaaacattatcgggtagtgcgccagccgcaacagatacagcaaaaaaaacgtggtgatggactgactgaggtcaaagcaaaggccatattggcgattgcagatgctgataagcaagtggccgaatataccaaaaaaaatcaggtccaaagccagcttgatgcaattttacatcttgatgccaagcaatttcggcaaattgttctgctgcctcaaggagactttcggcgttttctagatgccgacagtaatgccaaagaagatttacttcgggatttatttgggacccagttgattcaacgctggcaaacagctatgcaagcacaaaccaagcagcagggagccgcgattcaggatcaggaacggatgctgaatttgctgacgtcacagtttgaatttgccacgccgccatctgacaacgcgacgatggctgacaaattggccttgatgcgtcaggaagtaacgcagcaagcaacaaccgtcaccaacctgcaaaccatggcagaccaacgccaccagtgctatcagacggcccagacagctcttcagaccggcaagcagctggcacaagcatttgaagatcgaaaacaaactgctgcggctttggcacaacttgctgaacagaagcaaacacagcaagaccgtcttaagttaatggaacggttaacctgggttcaagaacacgaggcagctgagcaacgggtgcaaagagcagctcgtgatttaacgatagccaagacgcaacttgtacaaacccaaacggcaatgaaaaccgctcagcaggccatggatcaggcccaaacgaaattaaatgatttacagcagcaggattcggccattgaagccaaaaagacgcaacttgatcaattgcaatcggttaaacagcaactcgttgcaattgcggatcaagaaaaacaagtagcccaacaaaccgccgcagttgcacaggcagaagcagcgtctgtacaggcgcaaaaaaaattggcaaatgatcagaaaaaacttgatcaatatcaaaccgagttgaaccaactagcagtgtcagatttggcagatcgagcagctgaccataaacaattagtggcagcgctgaaaccggtagccgctaattatcaagatgcgcacgctgaagctgaacaacttgccagcaagctaacggacacaaagacgttgctgattcaggcgacaaatgtgagtcaatctgccgagcagcagttgaatcaattgcaacagacccagatccgacaacaaattgcccaattggcggctaagttgacgcccgggaccccttgcccggtttgcggcagtgtcgagcatccacacccggctgtagccttggatgaaccgctggtgactgaggctgaggtgaaacaggctacccaagcacgccagcaagcagcggcaaaagaaacgactttgcaagcccaggtatccaacctagaagaacagcacgctgccgctaccaaaaagtcaaatgtagcaaagaacagtttttgggcgcaggtgagctcaagcatagatgcagtgagtccccaaagcgaacagtcagatgttttgaaacagctggcaatacttgaagaaaaagcacaggctgcagtccaagcgttatccgccgctcagatcaggcaggatgcgctgaaaaaagcaataacagttggtcaaactgttgtgagcgcagatgatcaggaaattcaagcaacccaaagtgcgcttaatacagcgaagattgaggcggcaaaagctaacagtgtactgacgaccatgaaagcaagtttacctgcaggcacgactgatcttaagacagtaaccgaacagtcgcatgtcttgactgaagcaatcaagacttaccaggaacaattaaaaacggcgcagcgtcagttaagtgagttcgatcgccagttagcaggcttacatgcagatgaacgccatgctactgaccagatcgcgacactgaaaaaagagcaccaggaagcagaagatggctttttatctgcagtaactgattattttggttcggatggtgtcgcaaaatttgctgccatgcgcgagcaattagggcaattaccacttttgcagcaacaaacgcagcgttataaggatgacgttttaaagcagcagacattactggcagccgctaacaaaacgattggcaatcaaccgcaacctgcccttgatcagcttgaggctcaagcaagtgcagctgaagcagaggcaacaaaagcacaaactgccttcattgaagcaaagcagaaacatgatacggcccaaaaattgcttgaacaggccgcagatattttagcggccaatcaaactgctttggctgcctatgccgacttgcagacactgaccgccgttatgaacggcaatggtcccaagaagcttagtttggaacgttacgttttacaagcctatcttcaggatgttttggatgttgctaacactcgcttgcaagtgctttccaaccagcgttaccaatttgtgttgcatacggacttgggaactcaaaagatccattcaggtctggaaattgatgtatacgatgatcaggtgggtgaacgtcgcgcagttcaaacactgtctggtggtgaaagctttattgctgcgttgagccttgcattggcactgggcgaggtgattcagcaagaaagtggtggcatcaatattgatgctttgtttgttgatgaaggcttcgggagtttggataccaatagccttgatgtggcaatgaacgcgcttgaatcgctggaaggcgaatcgcgattgatcgggattatttcgcacgtgacggaattaagggataatattcccgatcagttgcaggtgcagccagcagggacagggcggagtcggattaaggtgatgcatatggcgtcggcgtaagatggtttgaggcccacttacactccgttttctaagcggccctgattgcgctcttaaacgcgttcgccaacccagaaacctgcacataaggacctcagatcccaatggcaaagcccggccattgggatctgaggccacttatgctccggtttctaaccgggttggctcacgctctgaaacgcgctcacagggccagaaacctgcgtgtaaggaccttgagcctaaatggcaaagcccagccatttaggctcaagcccgcttacactccggtttctaagcggccctgttcgcgctctgcaaaattatctgtgtcatttttgtgtttaagtggtataacagaagttgtaagggtcataccttctaactcacaccaaaaagaggcgagatcacatggcatcattgagcaaagaacaaaagaaagctttgatcgctaaggtcgaaaaggagcgccaagaacatcctgaaaagaagtcaaagaagtctggcttcgagacgattgacgaagaagcagaacgccttgaaaatgaaaactaatatctattaagttatgagccgcaaacatatacttgtttgtggttctttttttgtaagcgcgagccggcgcggttagcaatcggagtgtaagtggccttaagcgtgatggccggtttttggccattgcgcttaaggtccttacacgcagattgctgcgctggggagcgcgttatagaaagtgagcgtgagtcagcccggtcagaagccggagtgtaagtggccttaagcgtgatggccggtctttggccattgcgcttaaggtccttacacgcagacttctgcgctggggagcgcgttatagaaagtgagcgtgagtcagcccggtcagaagccggagtgtaagtggccttaagcgtgatggccggtttttggccattgcgcttaaggcccttacatgcaggcttctgggctggcgaacgcgttatgctggaggctacctgattacttacaactctctggaatggcgaagctcgcaaatggtgataactatgaagattcgaggtactgcaaggccattttggcatcatcggtatagctgttattgacaaggaaaataaagtgaaccatttatgcgtttcctgttttaaaaacttttttcggaaaaatttagcacttggcgttcacaagtgctaatttgtggtataactataggtggagcgagggagaaggaacaagagctccggagctaagatcgttctcctgaatcccagaagtctctgtttgaaaggaagttatctgttatggctaatgaagttatgaatcgtcgtaataatgagttgatgaatgatgtaaatgatccgttctttgacaacttggcacgtcggttcttcggcccggtatctgactggatggattgggcaacaccttccattgccagcacggccgtcaacggattgctgactgacgttaaggagaccaaggacgcttacgaagttcatgttgatgtacctgggatcaataaggacaacatcaagctgaactaccatgatggtgtcttgagcattaatgttcacaaggacgacatcacagatcacgccgacaagaacggcaacgtcatgatgtccgaacgcaactatggcacgatgagtcggagctatcagttgccaaacgttgatgacagcaacattaaggcaagctacaaagatggtgttctgaacatcacattgccaaagttaactgaatctaaggagtctggtcacaacattgacattcagtaatgtttatcatcaggcggctcaagattcacgaactgcattgcaagcatgatcagaagcggcaccactgtcgttgatgggcaaaacccagtagtaagcaaaatcagtcgatgagaattgcagcagttgcagtgatcattgaaccgtaagaaatcagtcccatgatgcgtacgatcgtggggttgatttttttgctctttttgcaccgagtgaggttggtttttagccgattcgatttacttttccaaattatgaaactccatggtaagctattttctatgatgacaaataacaaattaatggattggccgcctgaaaaagttgcggcatttcagcatgcactcttggattggtacgatcaccatgcacggacattgccgtggcgtcaagaccatgacccttatcacgtcatggtcagcgagttgatgttgcagcaaacccaagtgcaaaccgtcattccgtactacaaccgatttatggcgcagtttccgacagttgaggcgttggcagcagcaccggaagcgacggtgctaaaagcttgggaagggttgggttattactcacgcgcccgccgcttgcaacaggcagctaaacaaatcgtgaatgactatggaggtaagtggccgcaaacggctgcggagttacagacactggctggcattggaccgtatacagctggggccatcgcatccattagttttggagaggttgttcctgcgattgatggaaacgcatttcgggtctttgcccgactgtttaaagtggatgccgatattgcgcgcccgcaaactcgaaaagtgttcgatgacttgattcggccactgatgcccaaggagcggccaggtgattttaaccaggccgtgatggatcttggttcaagttatatgtctgccagtcatcctgatcccgcccattcaccggtgcgcgcgtttgatgccagctttcgcgatggtgttgtgcaggactacccagttaaaaccaaaaagccgcggccggtcattcatcgttattttgcattggtgattcgatccaaggccggttacttgcttgaacagcgtccgggtaaggggatgttggctgatttgtggatgttcccgttaattgatatggccgagcttgaagccactatggaaagcgaacagttggatgaaatcagtgctcggtttgcagacttgtccggaatgactttaacttttgccgatctcggtcgtcctcaggtgcaacatactttcacccatcaacgctggcaattgactttaatcggagcggatgcagctgctgccgaattaaaatttatgccagcacggtgggtaccggttgaagattttggtaaaatggcacttccgaccgttcaaaagaagcttaatcgggcattgggattaactgagccgggataatcatctggtgtagcagcgcaagacaattgttaactggtttggaaaaagcggcggtatactgtggtcatcaatgaaagcaaaggtggtcagattgacagttaaggtaactaaagacgtcacttatggcgatgcaccgttacaaaagctcgacttctatgaaccggataaaccaaatggagcagccattctagatattcatggtggcggctggtttcgtggtgaaaagcaaaaagaaagcgatatggctaaacggttcgccgcattgggttatcacgtggcggttcctaattatcggttggcaccggcagacttttttccagccgcacgtgatgacgttttagcggctttttcatggttgcgcacccatgctcaagttgagaatctgggtgtcttcgggtcgagtgccggtggatcactagccgttgatgtcgggctggctgaaggcgtaccaactgtttcttggtcgggtattttcgatattcagcaatggtttgcggatcatccagcaattgtggctcagcccgacaccaaaacggactttgttaagacggccagtgccgagattgatcaaggtgggcgcaatgatccattctacaagtggttcatcttgaattatgtcgatgcagatgaaacaaaattttctcaggttgagccatttgaccggttgacggctgatgcagggccgctgtacttggctaattcacaggcggaaattattcctgttagcgggatttatcgattggctcaaggggcagcaaagctcggtgtaccggtgactttgcaggtgattcccggtggccagcatgcagaagggtacttgtcggcagcgtggccggggacagtggcgtttttggcacagcatttattgaagggatcaatttgaaaacattagtgattgtcagtcatccagacattgaaaaaagtaacacccagcagtttttaaaagccagtgcggcaaccttgtcgcaggtagcgtggcatcatttggatgtgaatctgccttttgatgtgcccgctgaacagcatgccattcaagctgctgatcgaatcgtcttccagtttccgttgtactggtatatggcgcctgccagtttgcatcaatggctcacagaagtatggctgaagcagtttgtctatgatgcacatggtgggttgctgaggggaaagtcactgggattagtggtaagtttcagccagccagaagccgcgtatcagcttggcggcaaggtgggctttagcctcagtcaatttttaactccgtatgtggcgcttgcagaaaaaacgagcctggatttgcttgctcctttgacgatttcgcagtttgccaatcaaacggatatggctcaccaacagttgctggtgcggtaccagcaatatctgaccctggttcatcctgatgatcctgacgaacaggcgcagtggtatattgatcgcctgcaagctaacccggaaacgagcatactggcggatcaacttgctgcccaaaccgatgaaattgaccggttgcggctgactttacatgaattaaaggcaggtgagtcagagtgacgaccgatgaacaatggcttatcgagacggctgcccaacatcaaaaagacgcggcatcgtatgaaaatgcagcgttttttgcggctttacagacgtttgtcgccaagcaagctgagcgccgtgaacaatatgaagccgaaattgatgggcgcagttggaatcatgagcagtggtaaagttcagtctgacgacggagggacattgcaaaacgatatgctatgctttaattagcataaagtgttggaacaacgtgggatttaagcgcgcggttcacgctcacattaacgcgttcgccggcgcaggagcctgcatgtaaggaccttggacgcaatggccaaagcccggccatcacgtccaaggccgcttacactccggctcctgaccgcgccggctcacgctcagaaaaaagggagtatcaataatgcaagcaatgtttgatcgtcttcaacgttggtcgtggttgcgcggcctgcttatgattttgattggtggctggattttaattgatccgcatcaggtctaccgaagctttctgtggattgttgcagcagttctgattattgccgctattcctaaattgatcgatggattttctgcgcacaaaagttctggaacttatgggacatcgctttttgccggaggattttacctcttgctggcgttgctgattccggcaatcgtcaagccgctcatgagtctgggaccgttgattatcgggattatcttgatgatctacggggttaacaagattatcggcgctcgccagcaacagcaatatgtaaatgtttcaccatggtcgacgattatttatggtgtggccttgcttattatcgggtttatcatggcgattaacccgtttaagacggtgatgatggtcttcgccttgttcggcggcgtgcttgtggtaatgggcattctgcaacttttcactaaaaaaagcgattaagctgactaagcaaaaagccacggaggaatttatccatggctttttatattcgcatcacaactaactaactcacaatataaaaaacaggacccatgtatgcgcaatatcatcgcaacattggtcctgttttttttacgcaatggtggcaaggatactcaacgagctgttctgcggttagtcatcggtttattgtcgtggatacacaatttgattagcccaatgattgatgggaccgtatttgtggccaaccggaattggatggccaattgcctgattagtaaagcgtttggcaatccgaatagcgtcttcaacatcattacccttgccgatttcggcggtaatcactgccgaaagtgtatcaccggtgccgttaacgcggtccgtatcgtgataaggttcgctcagccaaaaagatttaccactttccagcaacacaaaatcccgaacttctttttgagtcggatcgtcatgggcaccttttaatacaacgtttttggctcctgatgcttgtagctgatgggctgcagcttctgtagcagcatcggtgtcgagtttcatgccggtaagatgttctgcctcatagtgattcggagtcaccacggttgctaagggaatcagttcatttttgacggcatcgtaggcatcttgttccagcagcatcgcgccgtgcttcgtgataatgaccggatcgaccaccagcgcaccgaaatcatactgttgccagtttttgataatcgcttgcaccaatgccttatcagccagcattccggttttagctgctttgattttcaagtcagcagccaaggatttgaactgcgcatcgatgaacggcaccggcatcaccatgctgtcttggataccataggaattaccggcaaccgccgcggtcaaaacggtcgcaccgtaaacgccacgcatgaagaaactatgcagatctgcttgaacgccggcactgccatcactgtcagtaccgccaattgtcatcacttgtggaaattcgttagccatcatgatcatctcctgataaaaaagtctgaactctcatcagcatgtccattcattggaaggtttgcgctaatgccaatcgttcatctgtacggttagttaaaagcccgtttttgaggtaaaactgcttttagccattcgccaataaatggatattgccgatttaattcaatcacctgagtttccggatctgggtatttcaggtaaatcatattattgtccggattaaccattacagtaaagagtttttgattgggcagcggtaattcatatacaccttggtgactgccttgccgcatcaaaatcgcattactggaagcaatgacgaacagttcgtctaacgcaggggagtttgtcccggcagaaacccgcacgaccagcttgaggtgatggttgaccagttcttccggaattgtggtcgaggcccattcaaatcggtcacctttaacctcttcagaacctaaatctttccaatcgtggccgtcttcgtccagaacctggtagtcgagaactttgctatcccgatcaaggttagtctgaatgctgaattcgccggctttaacaaccgtttttttggcgactaatggtttgagattatcaaagcgggttttaaagtgtaagccgttgattggctgcaaaaccgtttcgtcaatggttgcaaattgatagccgccttgattaagggccttggttaaagcagacagtgctttgatttcatcggcatcgtaaggcagcgcgttgctgtcgcttgccgtaatttgtaacagggttggcaaattggcggctttcagggtggcgcttgggcttagcggatcaacaatggttagcaggggctgattgtcttcttcagttgcctgaataagcgtgatttcactgtggtgaggatcgctagtcgtgtctttaaaccacaatgtctgtaaaaagttagttggaatggcagcaatattttgcaacgtttgatagagtttgtcacgcatcaagcccgtgtaacttgccagtaacgcggttagtgcatcatcatttgaaccccataaaggcgaatcggctagtcggtcagcttcggtttgatacgcggtgctgatttgttgacgtagctgtgagacatttaacggttttgcaattagggcagccaaatgtgtgtcattaagattaagcatgtgtgcgccctccttcaagctttaatgactgcatgaaatcatctttcaagttggcaagaacattttcaaactccgcaacggaactgtaggtgctcaagacagcttgatattcataacgggtaatggctgcagaaacttccaattcgcgtttacgtttatcgaaggtgtcatcagccgccagcttttctttatcaaagcgggccttaagttgcgaggcatcggtttttgatgcatgggaagctggggcatcggattcatcacttggatcaatgaaatttttcaaaagtccgcggaagccaccgttaccttgggcggattgatcgcgttcaggtgctgcttcagcttcaagattatcaatttgcgtatgcagtgaatcaacatcgcggtaaacttccttgcgcatggcgtccaactggcgatccagatagtgatcaggatcatcggaaaaggcttccagttgcggcaggatcttgcgttgttcatcggttgactgggtaatcgcgcgcaaaatgacgttaatatgaccaaaatcgcggcggtgataccagttgccaaaataaatcgtcccttgatcattgacttcaaaaaacggaatatgttgccgcaagaaatcaataaacccgatttgtaaaaaatcatgcagttcggcttgggcgcttttgtcgtaagctaaaatgtagccaggcgcttcttcaatatcgaggcgcaaattctctgctgtggcatcgattccctggtaaaggcggtaacgtgattttttatgccaagcatcggtaaaatcactaaagaatttcttttggtaagtaagactcgtttcgattgacatataatatcctctcacattctgtccaattattttaagtgtaccgcataaacgggcatataaggaagttttcttctcatttagagctaagaaggtcaaatcaaccgttttaaatggatgcatgctaaaatgagctcgtgtagggtgttcgggtttacgaaatgaggtaagaaaatgaaaattgcagttttgggtgcgactggacgtgccggaagtgccattgttgccgaagcgagaaaacgcggtcatgatgtgttggctgtcgtgcgcgatccgcaaaaagctgcgcgccggctgggccaaaccgttccgacgctggtgaaggcaccactagatttaagcgaagcagatctagatggtgttgatgccgtcgttgatgcgctgagtgttccgtggggctctggccgcggctatttacatttggattttgccacgcatttgattagtttgttgcgtaatgcggatccgttagccgtttttattctgggaagtgctagcttggcaatgccaggtgccgatcatccgatgattcttgattttccggaaagtgctgcgagtcagccatggtatgacggtgcgaagtatcagtatgatgaatatcgatttttgcagatgaccgataacgttaaatggattggtatatccgccagcgaggcttttccaagcggaccggcaaccggttatgttgcaggcaaagataccttactggttggcgaagatggtcagagtcacatcacaacaggtaatatggccttggcagtcttggatcagctagagcagccaaccgctttgcaagatcggataaccgttcgcgatgtggatgaatgagcggtaatagcaaccaaaaaaacacgatttacgcaggggcaaagccttgtgtgaatcgtgttttttggtgatttttgagatgaatgagttgggaaaacgatgggtggttagccgcggtatggtgggttggtagtggtggttatgcgcttatcaactgataaaggtttggggatatagtttgggtactagactaatttttgtgttgtttgggggtaaggctttttagtttaggcagttaagggagctgatattgcgtttttatgcggtcccccggcacagaagtctgcgtgtaggaaacttggacacaatggccaatgtgcgaccatcacggctaaagactgtttgattttaagaaagtagccgggaggacggaaagactttctggtttaggcaattaagaaactgacattgcgttctataacgcgctcacagtcgcagcaatctgcgtgtaaggacctctagcctaaatggccaaagcccggccatttaggctagaggccacttacactccgattgctaagcgctcctgttcgcgctcaccataacgcgctccccggcgcagaagtctgcgtgtaaggacctcagacgcaatggccaaagcccggccatcacgtctgaggccgcttacactccgacttctaaccgcgccggctcgcgctcaacaaaaaaacaccgcgtattgggggtacgcggtgttcccgtgtcagcgccattgggggtggagctgacttatttttactttggaggagtaaaaatgaaaaaagttgggttggggtagtagtaagaagggggtaaacttccttgctacacttaagagaataatcgctaattgtgaactttttatgacgttctggcataaaattttagaacggacgtttttttcgtcatcagtgcacttttttcggccgaatgactagttattaaaaagaagctgtgagatgtcagtttcttgcaataataatcaatcaaaatgataaacactgtcagattaaaggattaatcatttcttttctacaaaattagagccgttaacaggaaatcgccacaaaaaaacgttatattaagggtggaaatggttctaatagaaatttgaaaatggggtaatttgatggacaactcagcatcaaacatcaatgttgatcaactgaccactgaagagaaaatgaaactgacttctggtaaggacttctgggcctccgaagcacttcctgatcataagattccgagtatccgaatgagtgatggaccccacggcttacgttaccaagccgctgctgctgaccatttagggattaatgacagtgtcccaagcacaagttttccaaccgcgagtgccagtgcggctacttgggatccggaattgattgccgcaatgggggcagcgattgggcttgaggctcagagtctgggagttgatgtcgtgttgggccctggggtaaacatgaaacgcaatccgttatgcgggcggaacttcgaatattttagcgaggatccatacttggccggcaagcttggtgcggcctggattcaaggcatgcagaagcaaggaatcgctgcctgtctcaaacattttgctgcaaataatcaggaaaacggtcgcttatcgtccgattcgatgattgatccggtggcacttcatgaagtttatttggaggccttccgcattgccgttactgaaggccatccagaatccgtcatgtgctcttataacaaagtaaacggtacttatacgagtgacaatcgctatttaatgacaaacgtgctgcgcgatcaatttgggtttgatggtgcggtcatcaccgattggggcgcgttgaacgacaaagtggctgcgcttaatgccggaacggatttagaaatgccaggtgatgatcatttatttgacgatgaggcgttgaaggcgttgcagtccggtgaattgcagccggccagtttggatcgtgcagcagctaatattatcaaaatggcgcgtaaacatcggcctagcttccatggtacgcgtgaagccttattacaccaaaatgctcagttagcacagaaaattgcggaaaatgccattgtgttactaaaaaacgacgaccacattttgccattgcagaccagtgaatcattagcggttgttggtgagatggctaagggaacccgctttcaaggtgcaggttcttcccatattcaagcagctgaacaagtgtcgattttgagcggaatcaaacaggctgggctcacttatgatttcgcagccgggtatcgacttgatgatgaagttgatcaggagaaaactgcccaagcgttggaattagcgcggacgcacgacaaggttatttttgttgccgggttgcccgataactatgaatcagaagggtttgaccggaagaacatggccctgccaaaagtacaaaacgacttgcttcaggccattgcagcgattaacccgcatgtcattgttttattggtcgccggagcaccggttgagatgccatggttagatcaggtacaggcaatcttgaatttatatttaggcggggagcatattggaacggcaaccgcacgggtactgaccggtcaagtcaaccccagtggcaagttagccgaaacctatcctaagcgctatcaagacgttgtgtcagctgagatttatgataaacacacgcgcgcggttccttatgtagaaagttcctatatcgggtatcgttacttcgataaggcaaaagtaccggtggcgtttccgtttggttttggtcttagttacaccacttttgcgatcaagcatgtgcggcttgtcaatgatgaagtaaccgatgcgcagccggtgacggttcaattagatgtgaccaatacaggggatatggacggggcagaagtgattcaggcttacgtcaaagaacagcagccgcgtccattacggccggaaaaagcgctaaaggcattcaagaaagtctttattaaagctggtgaaacagtcgcagttcagttggaattacccgcgcaagcatttaaagaatggcaggaaaagacccagacctgggtgcttcctgctgctgccaagtcggtagcaattggcacaagcgctgctgatattgtggcaacgttgcctgttcatttaaacggcaccaacgtcaccaatttcaaaaatgttcctgattggtataccacactatcgggcaaaccgactgtccatgattttgaacagttaaccggtcaaaaggtgccaccgcatcatgagtttgttccgggagaattcacgcgactcaatacaccgcgcgaaatgcaaaaacattcatggattgtccgtacggtaacccggatcacggttcgaatgcgaacaaaagactatcttgacaaagaaggcccggaagctaagtttcagcaagcaattgtgctagatacaccattaattcggctggcccagcaagcaagtggcattttaaagttaagcatggttgatcgattggtcgctgcagccaaccatcaatatctcaagatgatttttggataacaagtgtattgtaaaataattagaattttttcttgacgcggacaaatgctttccagtatgcttaatcccatacaaaaccgagggagtgttcaccgtgatgaattatcggcaaacacaactaaataacttttttggcagcttttttggatagcggtttgcactcggatgcaaaccgcgcaagcaacggtttgcatccatgaggctgtcacattgaatgtgccaacaaagccgtgtggatgaacaatcatccatgcggcttttcgatatcgaaaactcgggccagtcgcatggataaaatccaacggctggcccatttttttgtgagcgtgaaccggcgcggttaaggatcggagtgtaagtggccttgggcgtgatggccgggctttggccattgcgtccaaggtccttacacgcagatccttgcgccagcgaacgcgttaagattgagcgcgttacggctcgcttgctgagggctaactcgtctgacaataccggttaatcagacgcgtttacctaaaaagtgaccaaaaaaggtactcggttttggcttttgttaattaaaaaataacttggacggatacgtgatctgattgtctaacggcgctggatcgcgcaaattgggaggaattttaatgaaaaagcatctcgtactcacgatagcagcaactgtcttgattggattgaccttaattggttgcggtaagaaatcaagtgccgccagcagtcgaacggttaaagtcggtattttacagttaatggaccaaactgctttgaccgaagcgcgtaaagggtttgaatcagaacttgccaaggccggatacagtggcaaacggatcaaacttgattatgtgaacgcacaaggcgatcaagctaatctcaaaaccatgagtgaccggctggcgcgcgataagaatgatgttaacttggccattgccacaccagctgctcaagccttgcaaaaagccgataagaagacaccgttgcttttcacggcgattactgatcctaaatctgcaggactggtgacgaatttagaaaagcctgacaagaatgcgaccggggttacagatttagtcgcggtggcagatcagattaatttgctgcatcagactttcccgcaagccaaaacgattgggttaatgtacaacgccagcgaacccaattcggtttatcaaatcaaacatgctaaggcacggctcaaacagttagggttgcgctatcagattcgcaccgcagcaaccaccaatgatgtgcagcaggcagccgaaagtttagccaaggatgtcgacgccttgtatctaccggccgacaacgtgatggctgctgcaatgccgacgatcggtaaagttgccaaagctcaccagattccggtcgtcccggccgcatcaaccatggttaaagacggaggcaccatcaccaaaggcatcaactaccgcgatcttggcaaacaaactgcgaaaatggtgatcaaactgcttaagggaacagcagtcaaaaaactaagcgttgaaaaaccggccaaagttgaaaccgtaaaaaatgaagtgatgctaaaaaatattaagcaaacggtgcacctgccaaaatagccatgatatcaacattctttgacatttttcgatattctgaaatccgattagccaacctaccggcgaaaacttgtgttgacaaactgagattatgagtatacgctttgaaacaagccagaagggttaacttctgagcaaaggagtgttgatcatgagacaaagaaaaacaacacaacttaatcacgcgtactattacggctatttcggataatggtttgtatctcatggatacaagccaatcaggtttgtatccatgatggccgtgagtatttcacttgcaattaaccgccacatggacgaattcatccatgtggctttttctttcccgggaaaaaagtaaaaggccagtcacatggatgagaaaatccagtggctggccttttttggcgagtgagttctgtagtgcgagtgccagtgtgagtagaaggtgactcgcgctcaccataacgcgttcacagggccagaaacctgcgtgtaaggaccttggtcgcaatggccaagagcgggccatcacgcctgaggccacttacactccgacttctaaccgcgccggctcgcgctcactttattttaggaggaagaaaatgatgattaaaagaatgatgattaaaaaaatggctgcggttgtagcagcggcgttgacggttgtggctttggctggttgtggtaaatccacgagtgctgcggctgataagagtcaggtgaaggttggggttttgcaattgattgatcagcaagccttaaccgcagcacgaaaaggttttaccgaagagcttgctaaagccggttacaagggtaagaagatcaaacttgattatgtgaatgcccagggcgatcagtcgaatttgcagacgatgagccaacgcctgaagcgggacaagaacgatgttaacttagcaattgccactccggcagctcaggccttgcataaggaagatgctacaacgccaatgttgtttacagcggtgacggatcctaaggcggccgggctggtaagtaacccttctaagccagacaaaaatgcaacgggggtaacggataaagtcgatgttgcagggcaaatcagctttattcacaaagttttccctaaagccaagaaaatcgggttgctcttcaatgccgctgaagaaaattcccaggttcaagttaagcttgccaaggcagcgattaagaagttagggttgacggcagttgagaagaccgcggcaacgaccaatgatgttgaacaaagtgccacggccttgatgaagcaaagtgatgtcatctacattccaaccgacaacacgatggccgcatctatggccaccattggtaaggtcagcaccaaggaaaaagttccggttgtgccagccgatgccacgatggttaagttagccggagttgcaacggtcggcatcaattacgaggacctcggcaaacaaaccggtaagttggcagttaagcttttgaagggtaaacaggtcaaagatttggcagttgaaacaccagccaaaacccggttagtcaccaatcccaaacggatgcagcaatttgggctgactgaagcgatgttgaaacaagcagaataggcgagcatttttaaaaaggggtttcgttatggatattgtgacatcaagtattgcccaaggattattgtggtcggtcatggccattggcgtgtatctgacatttcgcattttagacattgccgatatgacggcagaaggtagctttccactaggcgcggcaataactgctcaggcaattgtatcaggagttggcccgattgcggcaacgttgctgggatttgccggtggggctgctgcaggtgcggtttcgggttttctgacgaccaaactgcacattccggatctgctcactggtattttgaccatgaccggtttatattccgtgaatcttttcatcatgggaaaagccaatgtcagcttgattggcgcggtcaagactgtgttcaatttgacagatagcggggatgcgacaacgaccggcatcatcgtgggcgctattgtggtggcaattgtcatcggagccctggttttcttcttccataccgaaatgggattggccgcagccgcagttggtaacaatcagaatatggcggctgctaacgggattaataatgacgcgatgaagatcattatttacatgttgagcaatggcttgattgcattgtctggcagtctcatggcacagactaatggctatgctgatctgtccatgggtattggcacgattgtaattgccttggccgctatcatcatttccgaaatcctggtgcgcggggtgccgttgtgggcgcgcttgctaatgatcattgtgggtgccgtgatttaccggctcattattgcggtggtcttggacatgggcgtggatccgaactacttgcgcttcttctacgcactcatgttgacgattttcttatcactgccgttattgaaaaagaaactctttcaggtaaaagtacgacatagcaatcggcaacaggtcaagtctgaccaacgcatggttgccaagacatcggatcatatgacgattgcaccggcagagcaacaaaaggaggttcattaacatggcagttctggacgtacgcgggttgcaccaatattttgagcaaggtaccgtcaatgagaatcacgctttaaaaggaatcaatttgagcctggaacgtggtgaatttgtcgctattattggtggtaatggtgcaggtaaatcaaccttgttaaacagcatcgccggaacattgccggttaatcaaggccaaatcctgatcaatggcaaagacgtcacttaccaaaatgttgcgaaacgggccaagctcattgcccgggttttccaagacccgcgctctggcactgcctctttattgacgattgaacaaaaccttgccttagcagaaaagcgtggcgaatggcgtaatttctgggcaggtggcgtcaagcgccgtgatcggcagcattttcaggagaaactggcgacattgggtttaggactagagaaacgtcttggcgcagaaatgggcttgctttccggaggccaacgtcaagcggtgactttgttaatggcaaccttgaagaagccggccttgttgctgctggatgaacatacggcggcgcttgatccccaaacgagtgcgaccgttatgaccttgacggatcaaatggtgcgcgctcaacagattaccactttgatgattacgcacaacatggcaagcgcgttgaaatacggtgaccgcttaatcatgttggatcacggggagatcgctgtcgatgtacgcggcgaggaaaagcgacatttgacagttgaagatttgttaacactgtttaaagaacgcagcgggcaggaatttgccgatgatgcggtcttgctgagctagtttcgaaaacttaaataaccggcatgcgatcatgattaaatgagcgcatgccggttatctttttgcctataaaatcgatttacttgcaatctagctgattttcacaaccgtccgcagtgcgggatgggtaaagtgcttgttcaaaacgcgcggcaagtcagagagactgaccgtttgataaggcaccggagctagtttggctaatgcggcccaggcagcttgacgtaaggctgttggcgcactcacagaatcaatccctagcaagctgatgttgcgcaaaatgaacggaaataccgtgagcggcagggaagcgcctgcagcattgccacatagcgcaaccgctccaccgtaccgcatactcggtaacaggctggtggtgaaactaccaccaagcggatcgatggcaaagtcaaattgttgacgcgccaatgccttgccttttggtaactcgttaagggctaaagtggcagttgctccgagcgcgcgaacctgttgttgctgatcaggcgtgcggacaagggccacgcggtttgaaaagccggcatttgccaataatcgcaaggcaatactgccaaccccgccagttgcaccaccaaccaaaatcaacggctgtcgtttaggtgtcattccggcgtgcatcaacgccgtgacacacaacgctgccgtcaacccggctgttccaaacgccatcgcagtttccagtgtgagatttttaggtaatggaagtgcccattgtgccggaacgcgggcatattcagcgtaaccgccgccttgactgacgcctaagccatgaccggttacaataatttgatcgccttttttaaactgcgcatcgtgactagcgacaacggttccgcttaagtcgatgcctaggatctgcggaaactgccgcacaacttggttttgtggttgataggccaatgcatctttgtaattaacgtctgaataagcaaccttgatcaaaagttcgccggcaggtaagtcatctgtcgtcatagtttgtaaggtagcttgttggccgtcgtggagcaatgcctgaaacggttgcactttatgaacctcctagtgagcgcgagccggcgcggttagaagccggagtgtaagtggcctcaggggtgatggcccggttttggccattgcgcctgaggtccttacacgcaggcttctgcgccggggagcgcgttatagtgagcatgagcaggtgaacgtgttatagcgcaattcgactcctaatctgacaaacggggcacggcaccatagcttgctcaagtattaactaaagcatagcagattcatcaataaatacaaaacaaccgttattccgcaccaccaatcaattccgattgttgccatgcggctaattcatcgcgatgctggcggcgtttgtaaccttccacgaccagcattggcaaccagatgaccgccaaaacaatgagccattgtccgagatttaacggtgccagccgaaagacctgttgaagcggggccacagtggctaacaacaagatcaaggtaatggtacccaacaagctgccggttaatatcggattgaccgtgaaggcagcgcgattaagtcgcccacgggttttgatcgggaaaatatccaacattgagccaatcgccagcgtcaaaaagagcatcgtcatgccgacaattggttgattggcgctcaagccaaagcgaccgagtgcgtaaacgccgaggattaggccaacgtaagtcgttgtccgcaccgctactcgtttgccaagcccactggtaaaaatgctggcttttttaggaatcggtttaagccgcatgatgccaggttcggctagttcacggctcaagaagaagccgggaatgccgtcagcgagcacgttgacgattaatagctgttccggcgtcatgatcgcaccccaaccaactaaaactgcgatcagcatggtgaaaatctgcgcgaaattgacggaaatcagaaattcaacggccttgaggatattttgataaacagttcgtccttgtgccaccgcatcgataattgtcgcaaagttgtcatcggtgagcaccatatcggcggcgtttttggccacgtccgttccggtgatgcccatagcaatgccagcatcggcggcttttagcgcgggggcatcgtttacgccatcgccggtcatggccacgacggcttgttgctgctgccatgctttgacgattctgattttatcggtcggagtggttcgggcgaaaacgcgaatttgcagaatatcggcggccaatgcttcatcactcatttgactcagatcgtgcccggtgatagcgcgttgaccgtggtcgaggatgccgatgtcttttgcgatggcagtggcagtgacaagatggtcgccggtgatcatcacggtaataatgcccgcatcttttgcggcttgaatcgcagccggcacttctggacgcggcggatcaattaagccaatcagtcctgaaggttgcacggcggttaattgcgtctcccagtcggcaccggggtcgttttcgaattgctggtaacctgctgccaagacccgcaatgcctgcgcagtcatctgatcatgaatcgctgtagcttcctcgtgccaatgatcattggaaaaggcaatccgatcagcagcgcctttgatgatagccagaaaatggccatcgggagttttgtgcaaggtcgccatggtctttttatcggatgaaaatggtgactcggcaattcgtggatagcgggtttcaagatcatcgcggtttaagccgtagtgggccagcagccgaacaattgccagctcggtggcatcaccgatatccggttcgccttgtttggtgagccgggcgttagttgccagccctaaataagtcaaaaattgctgctgattcgttgataagggttgatcggtcactttttggagtgcttcacgaaacggccaaaaatgggtcacggtcatttggttttgcgtcaatgtgccggttttgtcggaagctataacgttgacgttcccgatggtttcaaccgcggtgacttgtcgaataatagcgtggcgtttggccattttctggacgccgtgtgccaagctgagtgtgacgatgaccggcaatgtttccggaaccgccgcaatggcaagactcacaccgagcataagactttcggttaaggtttcttggtggtaaagcatggacaacagcatcgtcagcgcaccgcctaagatggccactaacgataagcgtttgcccagtgcgtttaggcgtttggctaatggtgtcgcttgtttttgcgtttgattcaataatgatgcaatttttcccaactcggtctgcataccggtggcggtgacaatagcgctggcttttccactggtaattgccgtaccggaaaaaaggcgattaacggcatcgccaagatcatccggcacttcagtcagtggcgcggcagatttggcaacggcggaactttctcctgtcaaaactgcttcatcggtttcgagatcctgactgtgaattagccgcgcatctgccgctactgcatcacctgctttgaggagcatcaaatcaccgcggaccaaatctgctgcggcaatggtttgggtcttaccttcacgaacaacggtgactgtttgaaccgtcatggcttttaaagctgccaatgctttttcggcactgtgttcttggtataaggcgatggcgacgttaaggatcacaatgctgccgataacaattgttttggtccagtcactgtcagtcgtcagggctagataagcagatagtgcaacggcaaatagtaaaattaacgaggtaatgtcgctaaggtgatgcccgatttgccgccataaactgggctttttggcagcagtcagttggttggggccatcttcttggcggcgtttggcagctgcgtttgtcgttaaaccggttgtgaggtcggtgtcaaaatcagcggccaaatcgctcggcgtcaaaagcgtcaggtctttggtcgttggtgttggcatatgctcaatcctttctggggtcgagttgtcttcgtacttacttttaataaccgtaacataatgatgcggtgcctgtaaaatcttgtgctgaagtgcgtagttgttcgacctcaccataacgcgttttccggcgcagaaatctgcgtgtaagtacccttggcgcaatggtcaaagtgcgaccatcacgcccaagaccacttacactccgattgataagcgctcctgttcgcgctcaaaaaaatggactgctttgtgttattagcagtccattttggtacagatatcaaatcttagttaccgttaattttgcaaggcgtggtagcggtaattttgttgttgggtcgtttgcgttttaaagccataagtgtcagctacaatgtagagcggtcggtgtcggctttgggcaaacattcggccgatgtagttgccaagtagaccgatgctgaaggtgatgccggcaccaacaagtaacgttgtcgcgatcacccaagttaataagctgagatgacctaaaaagaaactgatgccgacaatagccacggccagtagtagaaagaagccgctaagccagttggcaattgttaaaggaacggtggagaagctggtaatgccgttcatggcaaggtgtagcattttctttaatggataatgggtttctccggcggttcgtttttgccgatcatattctacggcaatttgcctatatccaacccaggccaccataccgcgcacgtaaggatcatgttcattcatttgttttaaaacgttcacgacgctgcgatccattaagcgaaaatcacctgtatcgacggggatgtcaacacttgtgagcgcctttagcacgcgataaaaagtttcggcagttaccttcttgaaccaagtctcgccgctgcgtttgcgtcgtttgccatagacaacatcatagccttcttgccagcgggcgatcatggctgggatgacgcttggcggatcttgtaaatcagcgtccatgacgacaacggcatcaccgcttgcgtaacgaatgccagcggtaatggcaagttgatgcccaaagttgcgcgagaagtctacgaggcgaatggttgggtttttagccatcgcggccttaatctgggtggcactgtcatcggttgagccatcattgacaaagataagttcataccgttctggtcgcgcccggacatagttggcgagttcggttaacgtttcgccaatgcctgcgctttcgttgtaaacgggtaagacaacggaaatgaagggatttgttttttgtcgcatcacgcttgctcctttctgaattaatgaaaattacttcaccatgctggcatcaagttcatacagcgtgccgctgcccatgctgcccatgccgcccattgccatacgaccaccttgattgctttgggcgttggtggttgtcttgctgccgtatttgcttgcggccacctttttgccgactttttcgacccacgcttcaatctttgaattgccggagcgacccgatgacaggtaatatttcatgtcgccacttttgaccagtgctttgaattgcttcaacgtaattgccggatcagtgccgttaaatccaccgattgccataaccgctttaccggatttgataatatacggggcggcagtgctagcgttactggtagcaaaaaggtatttggcattgccttgatgagcttcaacgtacttcaataaaccgctattgacactgccactaccgataccaccgctattaccgcctgacgttagcaaagtagggccagcggttggaatgcctgatgacgaaccggcaagtgtcggtgtcaacgaccagaaacctggtgcggctaagatagcggcaatcgccacgcccagcgccgatttccgccaggttttggttcgggcgatgaagagcagcgccaaaccgattacaccggcaatgactacaagaatcggttgccactgatagtaaagactgacataccaagtctgaagtgcagtcgttgcggcaagtgcaagcgggagcagccaactctgccagtgcctgaagcttaatctgaactggttaaacatggtgactgtgccgataccgaatagtgccgcgagtggtggcgcaagcataatcgtgtaataagggtggaaaaaactggcgattgaaaagaagcctgcgactggcacaagccaacccagccagaaaagcaagtgattttgctgacttgtggtttggtaccatttgcgttttcgatcaaggtaataagcaaaggcactgataaagccaatgatagccatcggtgcaagccagcttatttgtggaccaagatcagattgcagcaggcgcagtggcccggcattcccaattgaaaaggcgccaccgccgcgaccgccagctgcaccaccaccggtaccacggccgcctttaaagttgccctctgcaaagtttgcaggggcgttatttgtagatgtgccggatttggtcttcacagtaggttgtttaccgttagttccggctggcggcgtgccgccctgaccttgaccattacccgggcgaccaccaccatttccgccaggtggcgtaccggttgtgccctttgtgccggttggtggatttcctttagtgccagtcggtgccgtgccggttttgctattgttgcctttggtcgccccagatgtcgggttcatttcaccagtcgctttggtcttgctgttgcccataccggggaaagccgcaccggtaccggttgtttggcccaataatcgttcagtaccgttatagccaaaagccagctccatttctgaattcgtttgggaactgccgacatagggccgctggctggcggcggttgagtccacctgtagtggccaggcaagtgtcatgacagccatcgcggctaatgcaatccccagtgtagccagtcggcgccatagctgctgctttgatgcaagccagaaaaagagtaataaggctggcaaaatcatgaacgcttggagcattttaatgttgaacgagacaccgatcaaagcaaagctcatgatgaccagccagggcttgcggttggtgattgctttcatcaggcaccagctggcgagcagcagaaagaactgtagtgtggcgtccatgttatttgttcgggaatccgcgacaacgataggcgttaaggtaagtgccaatgcagctaagcgggcggcccaaacattaaagcggggtttgatcatgttatagattagcgccacgctgccgatgccaaacaaaattgagggtaaaacaactgaccagccgtgaacgccgaaaattttggcggaaatggccatgaaccaaagcgctaccggtggtttatcaacggtgataaagccagcgggatcaaatgcgccgtaccagaaattgtgccaactttggatcatactggtgatagcagccgtgtaataatcattagcgtttcctgcttcccagatattccagctgtaaagaaacgcagccagaacgagaatgccaatgagccaccaatcaagggtccactgtttaatttttttcatgtgccgtaactcccttttctcgaaatacccagaacttacttaaaaggaagttcgttgggacggtaatcataagtgcaaacatcggtgctaatggttttggtaaattcaatgcatcattccagaagcttgtgagtatcaggctcatgataaaggtgagaccatacgaaaaatagtatcgtggtgccacacttttaaggtcgcggtgatctttaaccttaaagacccaggtatcattgaggaaaagtcctaaaactgacgttaatccatagccgacacccatcgcagcggttggattgatcaattggtataatgtcaggtaaagcaagtatgtcaaaatagtattgataccaccgactaaaccgaagccaatgaattgtttcagcttttggcgcatcgaatcgctcccttcttgatgaatgggattagtatgcgagatgcagcataaattaaccttaaagccagcaatttttttcttaagctgagtttatgattttcatgttaagctgacgctgtgattgataagactgaaacattggctttggtggggatggtggttggcggctggtggttaggcccctatgcgcgccggctcacgctcaccataacgcgttcgccggcgcagaagtctgcgtgtaaggacctcgaacgcaatggccaaagcccggccatcacgtccgaggccgcttacactccggcttctaaccgcgccggctcacgctcagctcaccataacgcgctccccggcgcagaaacctgcgtgtaaggacctcaggcgcaatggccaagagcgggccatcacgcctgaggccacttacattccgatttctaagcgcgccggctcacgctcagctcaccataacgcgttcgccggcgcaggggcctacatgtaaggaccttgggcgcaatggccaaagcccggccattacgcccaaggccacttacactccggtttctaagcgcgccggctcacgctcacttttagaggagaatttatgatagttaaacctaaaattcttgtaattgaagacgatcctgatctgaatgagagtattgttgattttattcgggacttttctcagcctgaagctgctttgacgggtgctgatggtttgtatttggcagaagaggggatttttgatgctattgtgctggatatcatgctgccagagctgaatgggtttgatttgcttaaacagctgcgagctaagcaagtgaagaccccggttcttattttgacggctaaagatgccctgacagataaggtgcgtggttttgagttgggtggtgacgattaccttaccaagccattccaccgtgaagagctcattatgcggttaaaagcattgttaaagcggacaggacatttttttgatgaggatgggttaacagccggtccgtttgaagtccacctaaaccggcacgaagtcttaattcacgacaaaccagtagcgttgaatggaaaagaattcgacttgttagtgtacttattacagaatcaaaaaaccattattacgaaggatcagatttttgatcggttgtggggatttgattcggatacggctgtcagtgtcgtcgaagtttatatgtcgaacctgcgcaaaaagttaaaaccgatgcaagccgatgtatggatcaaaacaattcgcaatgtcggttacatctttcaggaaccggaggaccgtgcatgaatgcagataaaggcattaagcgacaacagcgacgtttatttatcggtcaactactgagctttgccggactttttctagtgttgggggtcattgtttttttcctttatgaacgttcgatttatcaagatatcgatcattcgctggaacaacaaaaaataatgcttaccaagccggcacaaaccatgagcggtgcaggtggtcccggacgcccggtgacttcacgaccagtaccttttcggatgaacatggtggtttttaataaaaaaggaaaaatcatcaatcaggcgatgttaggtgaacggttttatgcctatttcaaaacgttaaaactagatcgtcaggcagttaataagttgcaaaatttgccgacttcaaatggcacctttagaactttactggtgaaggttccggtgacggccgcagatcctcaatatgccgggcattatgtgttgatcttgcaaaatacggacgctcaagaagccgcgattcgttcttttcgtcaggttctgattttgacgattatcctattttgggcgttggcactgggcttgtcttattggttatcaacccgttcaatgcgtccgattgttcggtcatggcagcggcagcaggattttgtggcagacgcagcgcatgaactacgagcaccgctggctgtgattcaaagtaaacaggaagccttgctaaccaagccacaagccaccattattgacgaaagcgaggccattgcgacgtcactgggcgagaccaaacgcttgcggcaactcacggatgatttattgacaattgccaaggccgatagcaacacgattgaaatcgaattgatcgatctgcggtttgatcaaacactggccccgcaactggcttcttatcacgacatttcgattagtcaggataaatcgtttaccaccacgattccgccaaaaagccatgcctggtttgacgctgcacggattaaacagttactggttatcttactggacaatgcatttaaatatacgcaagccggcgattccatctgggtgaaggtcacccaaacctcaaaagagtggcaactggtggtgggcaactccggaccaagcattgttgacgcggataaatcacgtatctttgagcgtttctatcgcgaagatgcatcccgcagccgaaaaaccggtggcagcggtctgggactagccattgcccgctggattgtgaccatccatcatggccatatcgaagtaaaagatgtccatccgcatggtgccgcttttgttgtgaccttgccaaacaaaccgcgtggcatttaaaaattaaatacgaaaaatagccgttctccaaactcataggcttggaggcggctattttcatggttgaaaaattaagggtgaagcagcagtgtgaagctttggttgcggatcgtcggacaagccaagttacccgttttagcttttaacgggccggattattgcggacaccattggcttgtgtgaaatcaatgaagcccatgttggtatcaatgtcgccaccatcaccacttaaaaccaaagtatttaaggtcgagttgaaatggacatgcatattggcatttaagtcttcctgcgaataacccttgatcaaaattggtccaagattactgctgatctcagtgtcatagtcggttgctgggtcactagccttgacgacattaagtgagaattgaacttgcatatgaatcatcgcgtgctgcgaatacggtccaacaccatcttcaaacgtcaaaagcaacttcttgtccgaacccaaatgcggttggatcttgttcacagctccttcgtcaaaatggatttgcatcagatcaacccctttcgacgccaatgtaggctgattaagcagtaaaagcaacttttttgactcactggtaattggaaaacagctactggttatttgtggtggaggctaagttggcgatgatccagatatcggcggactttaaaactggcgccaagtttgaagcaagtttcagcatctttcaaatcgaggccggttaactcgctaatatgattgagtcgatagcgcagggtattgaagtgaatgtaaagtcgtttagccgtgtgcgtgaggttttcgcctgcttccaaatacgcatcaagcgttggtagaagttcggttttattcgtttgatcataaaccatgagcttttttacggcggggttaatgaagaacggcagaatttcgacgtgatcaacctgagccaacattaaatcaaaaaaagcatcttcgcaaaaaataaccggattgcgaggtaatttaagcttggccgttcgtttgcaaacagcataagcagcgatggtatcctctggccgatcgtattggttcgagacaattaagcggcaatcggtccgggcagcaatcgttgccagatgttctttgaacgactggctgttgtattcaggtaaatcaagcgaaacaagcgctaaacattgatgatggtagatagtcaccaaagtttgggcaaagaacggtgtagaaaaatattttaatcgttctcttaaagctgctagtgattgattcgtgcaaggttcggccttgattaaggccatgcttgacgggaggatggctttttgtcgcgcaaattgagcggcaaaggtttcggtttgctgttcggtcagcaacattgtgagtaaatggtcacgttttgaggctgcagttgggatgattcgattcttgactaatgagcgtgtgataattggtgcgacagcggcgaactgagtatattgccgcgcattcagtggcgtttgcatggtcggcatgacgagatatcccaatgcgtcattgtgataactcggtggtaagtataaaagtggcaattgactagccgataagctgatttgtggtcgcttcgggatcgtaaaatgatctggaggtgccgatttgcttgctgtcagcccattatccaattgcaaatattgttggaatgactggtgatcttcaacttttaaagtcgtcactaccggatgaccgaccaaatcgacaactgccagcggattgccaagtatgcgcgcactttgtttaagaactgtatcaaagtcatccgtgatcgctttgagagccaagtgattcgtttgttcctggagatcggttttggtggttaaaagacacccgatgcgttcaaaaagtagcggtaattcttttggggatgagtgcggtagttggatcgaagttgccggtgttgttcgtgaagacggcatgattagctgaagaggctgattggcttccaccttaacctcaaacgtcatggctggcacctgatttgtccgcagagcacctagctgcatattgatgatatcgggattgatgttggcaggcaccgagccagtcggcattgtttgatttagacgatgcagaagtgttgtcaatttcataatagccaccttcagcgtaaataacggaattttgatgcttggcaaaaaccaccaaaagtatttgctcaattatgtgcaaatactatattcatgatacgttttgaaagcgctatcgtaaaggcgtattcggaagtatgaatgttcatatgccgtttaagccaacgtctttaacggctttagcagcagagtgaaggaggaaatcaagcatgaaagattttaaggggaaagtcatgatcattaccggagcggctcacggctttggtcgggttattgccgaagaaggggcaaaacgcgggatgaagttggccttgattgatattgatcaggcggccttgaatgaaacctatcagctggtggtggctcgaggcgctgacgctatcatgattccggcagatgtcacgaaagaatcagcagtcaacacggcaattgatcaaacgttgcgtacttttaagcagattgatttgttaattaatgatgccggaatagctttgcctggcagaatgtgggaactgccgacgcgtgattgggagtggatcttacacgttaacgtgatgagccaggtctatatgatgaaacgcattattcctattatgatggcgcaaaagacgcatggagcgattctcaatgttgcgtcaatcgccggtttagtcgacacaccgggaatgcctgcgtatcatgcaagcaagtttgccagtgtcggtcttacggaagcaaccgcctacgatctgcaacgtgccggagccgatattgagatgcacgtgatgtgtccaggatttgtgcaaactgatctttatcacactgaaaagcatcgtcccgttcaataccaggattcaagtgacccatattatcaaagtgaagcatttttaaaaggccagcagtttgctaaatatgtgattaccaacggcatgccgattgatactattgccgcaactgttttcaaagcgctcgaagacgatcagttttatatcctgacgcatccggaattcaatccgctgattcttgatcggattaatcgaattgtaaaaaacggcgcgccggatgttcacgtgatggacggaattatgtaaaggtatcagccaacactgacgcataaaaggagtgatcagcatgtctagttatgttgtagcgcaaaaagatgttgaaaaatttttgaatttaccgagtatgaatgaccaggaagggattagttttgcctatgctaccgatccggacgctttggccaagttgattccagcgccgttgaagttagtcgcaccgattatttgcggctatgttgtccacatggggcggcccagttttggcgcaccgtatttggagcagaccttatttgcccttgtcagttataaagataagctggtgggctcatatcccttgacgctgttgctgcacggtcccggtgccgaagcaggtttagttgctgggcgagaaggggcaagcatccctaaaaagttagccgatcgcatcacccttcgccgcaatgaccaaacagcaacggcaacagtggcgcgtcacggtaaaactttgctgactgttgcttgggaagcaggggatgtcaatgatcccgagattttaaaaacatttggtagtcaatttgcgctgaatcaggaatcaatcatgaacagtttcttcttcgactatcagcttgtccaagatgagcaaggagccaatcatttttccaatgttgcgttgctggcgactcagatgaaatcactagccgaccgagttgaaccgggaaaattgaccatcaaactcgactcaaccgaggatgatccgtttggagagttacctgttctcaaaccacttggggcaatgtggtaccattttgccacttcaacaatgtttaagacactgaggttggaagaagttaatgccaataagacggcaccgtatctgattacaggtcgttatgaccgcagtatgatgaatccattcgcaacaacctatactatctgaatgaaaacggttaacatattaattaagaaatgaggtaatttaaaatgacagaaacagtagcgccaaataaattaactaataacgatttagcaaaggtgatgttcgatcggcattcggttcgcaagttcgatccaacggtaaaaatcagccgcgatgagctgcaagatatgattcgggaggcaacaaccgcgccgtccgcttgcaatttgcagtcgtggcattttgtcatcattgacacccctgaaggcaaagagaagttgaaaaaagcggccatgaaattcaactatccgcaaattgataccagttccgccattattttcgttgccggcgatacccaatcacatgaggtctatcgcgatgtgtggacgaaggtttacgaggcaggcaaaatcagtaaagagaagctggaccaaatcttcaacaccttcctaccactgtacgaacatgcctcacctgaatttctgactttagatgcgaccattgacggcgctatggttgccatgcaattgttgcttctagcccgagcacacggatatgacgccaatccatggtccgggtatgactttaaaacgatcatcccaacattaggcctggatcctaaacgctttgtaccggtcatggcagttgccatcggaaaagccgccgaacagccattacaaacagagcgctatgacgtcaagcaactgattgattacctagattaaccgagtcacattaactgcaaagaagaaaggaaaccaatcatggtagatgcagtgaaaaccgatccattcggcaaagttaacgcaattgatgtgttagatttagcaagtttagaagcgcgcgctgaaaaagtccttggtcgcggtgaattcgggtacatcagtgagggctctgacgatggctacaccatgcaccgcaatacaacggcatttcaagacgtgcacatgctgccacgtgtgttacaaggcgttgaaaatccggatcagtcaacaacatttatgggcgcaaaacttgcttcaccgctgctaaccgctcccattgccggcaacactttagcccacccaagcggtgaactcggtttagcaaaaggcgccaaagaagccggtatcatgatggcccaaagcacctttgcctccaaaaccatcgcggaaaccgcagcggtcagcgatggtgcgccatacatgtttcagttatatatgcctaaagactgggaatattgtaaatacttgctagacgaagcgaaacaggccggtgcactggccatcattttgacagcagattcaacattaggcggttatcgtgaaaaagacgtgatgaatcattaccatctcaaaggccgacttgccaacctcgaaggctataacacagggcaatccggggttggcgcaggcggtttgtttaaagaatccatgcaaaagctggatcttggcctgatcagtaaattagccagttattcaggcttgccgattattatcaaaggcatccaacaccctgctgatgccgttgctgccattacagcaggtgctgcgggaatttacgtctccaatcatggcggccgccaactcgacggggcaccaggcgccattgaacagttacccgccatcgccgccgctgtggatcatcgcgttcccatcatctttgacggcggtgttcagcgcggcacccatgtactcaaagcgctggcactaggcgctgatctcgttggcattggtcgaccatttagttatgggttagcacttggcggctggcaaggcgtcaaagatgttgccgatcatctgaaaatggaaatcaacatcgccatgcagctgaccggctgccagacgatggcggatgtgaagcagatgagggtgaagacgagcttcaattaggtttactggtctagagtgtttagcttaaagctttaatgagccgaaatgttcctagagaaaagaatatcaaagaagcgccaatcacgatgaggagtacctcaaaagtgattgacgctttttctggatcttaacggacttgaaccgtcgacctcctgcatgccatgcaggcgctctcccaactgagctaaagacccgccatgcaacttggtactaatggatccaaacggacttgaaccgtcgacctcctacatgcgaagcaggcgctctcccaactgagctatggacccaaaacacaaatctaattgtactgaacttcgacgttggtgtaaaggggattgaccgtaattgggcaaggatgtttgacgttacgcaagggaaataatagtggaaaccatgcttatcttggaaagcacatacgaggcacttgcagaaaaggcggccatacgattgattttaaaatgatagcgcccaactttagaaaggttccatcaagcttatcttgattcagctcgccgggtgataagggcaatgaagacgttttggagcacaccaccgacaacgaagatgagccaagaatagctccaggtatcaaaaaggattgaggccaagaagtaggtgacaagaatcagtggccaataaacttgccggaaaagtgcaatgtcttgacgtgcacgctggttatggtggtgttttgctgcggaccaactgcttgtgtgttcgtcatggggtttcggagctgaatttgggactgttgtggcgtaggtgtaacgtttcagttgcgaataattaatggaaacataaagaataagataagtacctaatcctgcgataatgagaaacagcgcgccacctgcgtcatcgctgataaaatggctaatgtattcagagaggatggcagggatgagcgagcagatgcaaatcatgatgccaacgatcaggcccgcagcgaattgccgactataggccgccgtttcttgttgggcaaggtgcttggcgcttttggtgattgttcggtcattgggtaactttttttgctggctgtaagtggtgcctgcccaaatgaagagaccgactgcgatggcatctagtaggaacatgccgatgaccccgaacacttcataacgagaggtgccggcataagcaggtaaggcgacgctgatgcagcatagcaatacgccaagcgcgatttgtgtggcaaaatggtcaacgctttgccaaaaatgccgcagttctgattcggtaatggcatcatcgtcggccgccgtttcagcacggttgggatcggattgcaccggaaggcccagatcagcgcgcaactcgtctaaggaaccaaatgcactgatcacagcaccgatggctgcttcttcacttttaccgtcccgtagcaaatcgcgataatagtcgcgcatgttggcgagcatgtcggtttttgcctgttgggttttggcattatcgggtagtgaggcgaatagactatctaagtaggttttaatcgtatccatgggcaggttcctccaaaggctaaagatcggttaacggctgattcaggaataaatcgacaacggttttgacacggcgccattctgcggctttaactgcgagaaaggtttgaccgcttgtggtgatgcgatagtaagttcgcggttttccatttgtgacggcaccggggtaagcttcgatatagccatttttacttaaacggttgaaggcggcgtaaagggtggtctcgcgaatgatgtattgtcccgcggttcgctcgcgaatttctttgccaattttgtaaccgtacgaatcgccttgatgcaaaatggcgagaataaggacgtcattatagccacgcatggcatcactactgatcacgagcgcgcctcctttgtgcagggttggttggtgcagcggtggccgtgaactaactggcaaaggtgccattcgttgactactgcatctgatgaagtaatactaacacgattacttcatcaggtaaagtaaaaaaacaccttcaatcatgaaggtgtttgctgatagtcgattaatgtacaaaaacagtaacgaatgtaaccagcccaaacagaatacctggcatattagagataatgattggccaatctttgtaagtttttaaccagccatagcaagtccataaggtagcgttaaccattgctactaatggttgaattggattgactggatttccagaaaagtttgcaatgatttccggaatgtacgaaacatacattaaaatacaggtgaaagttgccagcttactgaggagtttgagccgctttattcgggcggggtcaacaccatcaggatatttcccagtatcaacgcgcatctaaaatgcccccttttaggataaaaataactttaacacgattggtcttaaatgccaagtcgaggtgatggctgtgatagaatcgaataggcggccagcatcgcgttggtcaatttttattttttctgaaaaagcacgaaatgagggaactttatggcagacaaagagacagatatggtcactcggattcagaagcaggaaggtgccgatgcgatcatggataaggggtttgtgaccgaacgggatatccctgaaatgatggataagacatggagtgagaagttgttagatgccattaatgatgaattgcgcctacgcacagttataaatcgagcagtgatgcaacaatttcattattatatgggtgatggaacgattatctatgatcccggccagctgaattcagaaggggcaaagattgcattgcagcatgctttaggtttccggaaataaaaccttgatcttaaagcaactggaggcatcatttacagagaaaaggtcccagtcaaaacgactttaccgaccatatgcccttcttctactaattgagtggcagcttttaagtttgctacattaatgctggtgaattctttggttaccgaagcctttatttgtccgtcttgatacagggttagaagtttgctgaggatcgcgccttgagaagcaatgcggtacgaaaaatcggttttggcaaacatatactcgtaatcaaaactggctgctttatctttgacgactgccaaatcaagcccggcttgcggaccgacaatgcacccaatatggccaaatgcctgaattaactgactggcagcagctagatacggttcgggatgatagaggattgcaataccatcaacggtttgaatgccggcttgatggatttgggcgatcagatcctggtggtaatcgagcggcacatcaacgtgatggtcgcgcagccatggatgatttttgggactactcgtggctaaaacggttaagccgctccaatgggctaactgactgagcatggaaccgacaccgccagcgccattgataatcagtaattgttgacctttattcgcattgtattcagggatgaagcccattttttcaaatagcaactcccaagccgtcaatccgaccagtggcagtgctgccaagtcagcagtgggggcttgttgtggtgcgagggcaactagtcgtgcgtcaactgcctgatattgctgattactgccgggtttgcaggtggtgccagcgtaaatgacccgatcgccaacatgataaccagcaacctgtgcgccaacttgggtgatggttccaactgcatcatatcccagcacttgtggcgttgcttgtcgcgttgccgcttgccgacgtttggtgtcaatcggattgaccgatacgccgtcaacctgtacaacgacttcatttggttggggagtcgggacagggagggcaaagctttggaagctgttttcggcagtgatcggtaagccttcagtaaaaccgatcgcaatattttgtgacatttgaatcgtcctttcgtttaatctgtcgttattgtaacctttttatgaagtgagttggaaatgcacaggttatttggtaaaatgtgcaggatattggcgaaacaagccaagtgtgcgcaacccagctcgaaaaattcgatgccgattgacgaatcataaaaaattaacgatgaacatgacgtgaagacgatagctttaaggaggctgctcgtgaaaaaatttggatcaaaacgtgaattgataggcctggtcattgtcttagtactggcagcggcggggtttgcatttttcgcgtggtacacgatgcgaccggctgatacgatcgggacaattgcgacaattagttttggcattgtattatccgccttgattggtatcgtcttattgttagatgctgcagccaggactcggtggcgacgtttctggattgatcttttgttcgccgggttaatgctggcgctgattgattattacttcctggatgtcaccgcgccgtggcagatgctggtgacgggtgctggcctggccgtggtattggttgcgctcctggctattcgaaagatcgatgaatagtgttaatgacgactagcaaaaaagctctccgaagaattcattcggggagcttttttgcttttacgtatgcgtgctagttcatacgctggacggttacaggaaccgtttttggcagtacttttgacagttcggttaacaggttttgaagactggcctgaaacgtcaggcggaccatccgccgtttgctaagggcaaatacggcaacaacccattcttggccatttggaaggcttaccggtgtcaaggtgatactggacatgtgcgtgtatggaatcacgcgcgccagtaaaccgttggcgatcaggcgagtaggggccagtccgccagtccctgccataatggataacaccaaaaagatcgagatgaaaataatatacggcatgttgttaactctggttgtcataaaccaaaagccaagcagcacggcccagataagctgagacactgcatatcgggaagtaaattgaatcttactttgccaaaaaagatagtagccagctaggccaattaaaacgatgtccagtccgatcaataacacattaaaactattcatgaggtactcctttttggtcaacttcatctgtggggtgatctgattcgtacaaaccagaaacctgctgataccagctaaagaatcgcgtgacgacaattttcaaaacggcaaaacctgggatgccgagaatgaccccgaccaagccaaagagattgccggctgtgagcaggacaaccacgatggtaatgggatgaagttcaagtttgctgcccataaccagcggcgaaatcagttgcgtttcgatcaaccattcaataaagaagacgacaatcacggcgagaatcatgcgtggagaagtcaacgcgcccatgattagcggtgggatcatcgcaagggccgagccgaaataaggaatcagattcaacgggcaagccaacaagccgaaaatcaaaccataacgcaacccgataaccgaatagccgatcatgaacatcaccgcaacgcataatgcaaccgtgatctgaccttgcacgtatgaaccgactttttcattcatttcatggagcatttgcttaaccgagcggcgcagttttgttggcacaatctgcaagatcatcggcgtgaacttatcgccatcttttagcataaagaagaggatgatgggcgcagtggaaattgtgacgaccacattgccgacaatgccaatcagattctgcagctgtgaaatggtaccagtcacaaaggcaccttgtttacccgtgaagaaagtctggacttcattggcaatttcgttgagatcatgttgcgacaggatgttctgtttgtcatttaaatcgtctaaccatttgccgatttcggtaaatatttgcggcgcggaatcaacgatactggtgatttgattgctgacagcagggataaaccgtaataagccccagaccagcaggctaatcaaaacaatgaacagcaatccgattgccaagccccgatgcaacccggctttttcaaggcggttgataatcggaacggtgagatagaagagaatgccggcaaaaataaatggcggcgcaataatccctagaaaatcaacgactggttgaaagacccaagcaattttggtaaagacaaaaatgactagcagggccaaaagcaaatcaactagcagaatcatgaacttactattaacaaagcggcgatagagccacgagtcggtacgtttcaaaggcgatcctcctctaataacggtaaaggttatattccggtcacagcacgccaaagcggtcagacagtcacaaaagcccttacaaaacaaacgtagggctggcaagttaaccttgtcagtaaccgacagctgaagccgtcactttagcgctgattttaagcacaaaaatcaagtacaccttgtataacaatgatactcgactgagtagcatttttcgaggatgggttccgtgaaatgtcaagaacgtgtaattgcagtcgttacataaaatttacaaaaacacgctgaaatcgttacaaatattataaaagcctaaacaaaggcacttaatgtaaattttacatatacaaaagctttacaaatcaaaaaaatcaggtatgataaagtcacaaccaaaacggtgagtcaatgtcggttcatccgatacggagaggagtgaccccatatgagcatacttcggggcgctaaatggacattaataactctgaccctggtcgcaacgttgctattgtttagcaactatgcgacggccggcatcttgttgatggctctagatattttcttaagcttcttctatgcagtcatcaagagcagatgtgatcggcgtcagatgcataagatgccattattgcataattaattgatgaaacgagaggctgagtcataattcacagcttcaaaatagaagcgtactatttcaggtttttacaagaaatagtacgcttttttgcttttccgtattagtataaatgagctttaacgattccagtgccaaagcggagcagtcgtaggtcggatggggctcagccgtggaacaacacagcgaccgggctttgtcgctgatgttgttaggcgacttggagactgccggtcttgcaggctccaagcgccgtctccgctctagcttcgcgtcgccaccccatccggccggagactgcggagtttggcacggcccagaactactttatttactttctcagctatagtattcggattttagtgggcatcacatcctgagatcgaattatgtcttagattgttttgtgagcgcgagccggcgcggtaagggaccgaagtgtaagcgggcttcggcgtaatgccggtctttggccattgcgaccaaggtccttacccgcacgtctctgcgctggggagcgcggtccatacacagataaaaagtgttaatggtcttaatattgagacaaaaaagatattttgttgcgcctaacgacagttttttcaaatgaaacagcaaaaacaattgcaaacgtccgttcgtattggtatgctgagtgtaacaaaagagaacgaggcggtgagcggatgccaacacaagcaagtcagaaacgttggaaacagattttacaaacaatctatgaagcgatcgaggatcatgggtacccgcccacggttcgcgaaatcggtaaatcagtcggactcagctcttccagtacggtcgcggcttacttggagaagttgctggcggctggcttgattgccaaagatccgtctaaaccgcggaccattgaagtcacggcagcagggcttgattttattggggttcaggcacaaggaatcccgattgtcggaacggttgccgcaggggttcccattacggcgattgaaaatattgatgattattttcctgtccctgacgatcttccgtattccgccgatgaattgtttatgcttcgggtccaaggcagttcgatgattaagatcggcattttagacggcgatcagattattgtcaagaaacaaaatgatgccgaaaatggccagattgtcgttgcgatgaccgaagaggatgaggcaacggttaaacgcttttacaaagaaaagcatggcgttcgtctgcatccggaaaatgatgatatggatgatatgtacttcccaagtgtcacgattctcggaattgtcgttagtttatatcggccggcgcttgtgtaatcagctcataattcagtaggacgaatcgccctcacatcaaaaagacatttaccagctactttatcgaagtggtggtaaatgtctttttgattatgtaccctgatgtcaacgttgcaaatatcaaggttgggcgaggcgatcaaggtcgtcttgcggcacctttttgtaaacgggtccatttggaagttgcttgagttgaccttttttggtgagctggaattgcaaagtagaactggccgcttgtggctgcgctttacccgtgaaggtgaaaactcgactttttaatgtaagctgagcggcaaaaattccctgatcggtactttcaaagacgccgccttggttggataaggtttcaagatagtagccgctggttgaggaagtgatccggatggcctttttgcgattatcgacttggacgaacgcgtggccgacaagtgtactcaaagtggctttgggaacggtctttttagtgggcttgacgtggctggtgacggtgctggtcgctggctgtttggatgtagacttgcctgtcggggttgtggaagagcagccgcttagcaagattaagatggtaagacatatcagctttttcatttccgagctcctagtgaataaattggatgcaggtcataacgataggaatcacgatcattgatagcaaggtggtttctgtgaccatgatggcagcgtagtcagcatcggcgtcatagagtttggccacaaccggtgcattggtcatgaccggcatgcaggactggagaataaagatttgtttcatcaaggtcggaaccggagcaaaagcaaccaatgcggtcatgagtagcggcgcaaaaagaaagcggccactaaagatgccccatgcttccttgctgagccgcaactgccgccagccggccgtatgcaaggcaatgccgataaaaaacatggatccgggtaccgttaagtcaccaacatatgtcagatccgccattagaaactccgggagcttgatgttcaataagacgagcacaatcccgaacatgaagcctaataacggaggtgagaaaaccttgccgagcgccttttttaaatcaaagcgtgccggtttgggcccatcaccttggataagataaaccccgattgtccaaaaaatagtggtattggccatgtaataaacgaggacgtaaggaaggctgcgaggaccaaacagtgccaaattcaccggtaaaccaataaaaaccgtgttggaattgaagaacatggacttaaaggtgccttttcgcgacttcggtactttcaacaagtaacaaaccagaaatgacaaggcgaaaaggatcatcatggataacaccgggaagaacaaatccggtagcaagcgcaaaagcatgccggcagtgaacttcgatgagatggtgacaatcatataagcgggcaatgcaacttgggttaccaccttggcgatgaccttgctagagtggctgttaaaccaaccgcgcgccgttagaaagtagccgatgatgatgagaatgagaatttcgaaaacgccaaaaacgcttgagataaatgctgtcaaataccgccacttccttataaattattttggtcgccgcaatgtaaacgttcgtcccaattcggcgtagttgggaccggcaagccgtgcgatgggggccaaggcggttgtattcacatgcagtgtcggtaaatcaagcacggtttctgcaaaatgaaattgacggatttctagaataaagagatccgtcatgatgattcccgccgcatcacgaatggggacatattggtaaagaatggtttcaaagcgaatgcgagcagcttgtaaacccggcacctgaatctccgtgctgggaatcaatggtaaatcaatcagcgttaattcactttgatcaggagccagccttgctgcggtttgattcatcgccttggtaagatcagtgctaaccatgtgcacaaccgcttcatggcgagcaaggaggttggccgcagtatcttttggcacttggcgttcgcgcaaaatcgcaaccgataacaacggcaactgattggaaatcccagttgtaaacgaaaatggtgctatattaatgagacctgctgtattctgggtggtaatccaagcgattggccgtgggatgatgctgccggacaaaagcttgtattgttcatgcggtgaaagttcgctggcagataggttaatcatcgtagacctccagtacataacaaatccgatggtgagaccttgcaatagaagctggtgtagcccaaaagtacgtcacgactgcaagtgtagcgcagggaacgaatggcgtcaaaaggacaagctcgtttggcattctcaagcactcactagtttgttcaaagttgtcagggcacagcggcagtcgagcttaatagccaaacgtaaggcatcacccagtgagacttagcgcgaacaaaaaagcgatgtttggcgattgagatcgcaaacatcgccgtataggcatcggaggaccgattgattaatggggactggtatcagtagcagaatttgatccgggatcagtcggagatggtgactgactgctagacgaactggctggcggctggttattttgatcgctaccaggcttttcggaatcgtcgccagtctgcgtaccctgaccgccagtttgagccggattgctacctgacgcgccgctttggctatgctgactttcgacactaggggcggcagaagatggtggttcagtggaaacagttgaggaaacagaatgactagtttgggagtttgttgatgacggtaccgagctgatgactgaacttgaagaaatgcttgaagcagtctgcgaggttttaaaatctgctagactgacaagctttttcttagaacgttgtagaggcaaactagttgttaaatagtgataattatgaggcgttttacccttcaacgagatggtattgttgaactctttcttcaaggcagttgtgtaactcagcacggtgccagatgcgtccttggctgaatattcatcaacagttgatgcctgcttgtgcttgtatgtcgtggtcgtcgtgtaagtgtagacattggcgtgatcggatacaagcgtcaacttaccttttttctgtttaatactaccggtatcattaatgacttgtggctgattatgcgcgtcaatgatgagcaggcgggtgtaggttttggcagtcgttaatttcacataaacagtaagatcgtgatgaacaccgttttcgtccgtgacatcgccagtagcggtataagtcccgcttttaaaagactgggtgactgccgaggtggatgatgcgctactgcttgaagaggaagcgacgggtccttgaaccttggctccccgaagcactagccagatgaagacaccgataaacagaataatcgcgccgattccggctagtgtgaggtaaagcgttctgcgattccggcgaatacgttcacgtcgcatggattgcctcctgagataaaatgaattttgttcaaaactgggatagatgaggatgaaccagaagtatcacaaatgagctgccggtatactgcgatcacataaacctttgtacgtgatacagtcgatagcggcggcccactaaaacactaatgacaggatcatgtctaatatgacttttgcacaatgatgttgccattagcaagtatcaaagtttcaatcggcatatcaaaagattcaactggccagtctggttggttaaacgccataaccggtggcaccagcgtcaccgtatggcctgggtaatcggctaaaaaacgatcataatagccgccgccaaagccaatacgaaaattgtctgccagcgaaaaaccgattccgggaacaatcaaaagatcaggggccggctcaacttgatcggcatgataaggcggctcgggaataccgaaacgactggttactagctgatcaaaaccggggtctggcaggaaaaccatttgacgtttaggcataacgcgcggcaggaacacagctttgttggcagcatgagcagctgcaatgataggggcagtgggaacttcaaaaggtccgctaaccgtgaccccgatactgtcagcttgctgccacagcggggttttcactaatgctgccaatagattttctccagccatctgggtttctttggccgctgtttgtaggcgcttgagctgacgggagcgaaattcggctttcgtagacatgacaacctcacttattttttaggaattcgcttaagacaaccgcttgattatgggtttcatctttagctccatataacatgataaccggatcctgctcgtgttcctttaaagttttaatgaagtttggcaaatccggatttttctctagctccgtcaaataacgctctttaaattcagggtatttttccgggtcatgaccgaaccatttgcgcaattccggagatggcgcaatggttttggcccataaatccaatgccgcgttgaccttgctgatgccacgtggccagattctgtcaacaagaacgcgaaaaccttgggcttggggtttttgataaatccgttcgagtgttactttcatatcgatcacctcatttcttatgataccagtcttggcaagtcgtgaatgttctagtcgcgatacggtatactaattaaaagaggtgtcatcatgattacgtgttatcaaattcaaaaagaccgcaatgtgcaggtggcaacggatgatcaggctaactggattagagtccaatctcctttaccccaagaactgaaaaccttggcaaccacttacggacttccgcaaacctatgtcgatgcggctttggataaacatgaaaatgcacgggtagaagggctggatccggctgataagatgccgggcctaattgttttacggtatccaatcgaaataaccaatgaattaggattccgccaatttaacaccgtaccgctcacgatgatcttactggccgatcgcgttatcacgattatgcagcatccattgcgggcttttgacgacttggccgcgcagccattatcctccaaaccggaagaatttgccttggaagttttgtggttagtgttgcaccaattcgtgattgacatggatcaattaaatgacgaaaccaaacagattgaaggcagtctaggcaaagcagctaaaaatactcagctttatcaattgatggcgatgcaaaagagtctggtcttttttgatgcggccttagagcactcggggaacctactcaagtcattacgtgcaggcgaacgctttttcacggcggctggttaccttcgtcggctgcatgacgtggaagtcgaggtggttgaggctcaaaccatggtccgcattacgaacaaattattggagcagtattcgactgctgtgagtgcgattgtatcaaataacctgaacctcatcatgaaggtcttgacgagcctgacaattattttgaccattcccaccatcgttgggggaatttacggtatgaatgtacggctgccatttgagaatgcgtactgggcattttggtggctgattggcggcaccgcggttttatgcggtcttgccgcatggtggttgtggcgcaaggattacttttaaagtggcagatactttcaacgcccgcaaaattggcttgtttgaagctaactatgagagaaaaatcctatataaaaatcgattctaacgtatttgctggaatcgatttttttctgggcagcattgcctcacttatatgattttaaaatcgattcgaaccgtttcatcgctggcgttaaaacgcgatctttgcgatgtacgatcgagattgtgaaggccggctgatgggcatcatcaatggctaaagtagccagacggtcatcggggttaatcgcgattctggttaagaacccgatcccgacattttggcgaaccaatcgcttgagtaggggcacatcgccggttcgataaacgatattcggcgagaatgtgtgccgttgttcaaaccaggcaaacgcacgggtgtggacaaacccctcacttaaagtaatgaattggcgtttagcaagcgtggcgaaccgaacgcttttgttggctgccaaaggatcgtcttgacgggtgatgatcacaaacggtgccgcattgatttgtacgacatgtaagtcagactcgactaatggaccactggcacccagcacggcgaagtccaacttgccatctttgatttgatcaagcaaagcggccgatccagcttcaacggtttccagttgtggcattaaaccggtattaatcaaatcgggcgcaatcttaggaaacagataaccaccgatgattggaggaagaccaaagcggattttagtttttttatcccatgcaatgtcttgttgggcaagtgtcaactgattcagaataatcgccgcatgggccgccagctgttcgccagccggggtcacactgatatcatgatgacggcggtcgcgaataatcagctgtgcgtgaaaataatcctccagacgcttaatcgcggttgtaatagtgggttgactaactgcgaatttttcagcagtttgtgagaaattgccggttttcgttagcgtaagaaaatagtcaaaatcccgagtattcacgtttagcctcctaaaaaaaagtgagcgcgagccagcgcggttagggatcggagtgtaagtggccttgggcgtgatggtcgctctttgaccattgcgcccaaggtccttacacgcagatccctgcgctggggagcgcgttatggagcagaaaagccagcgcggttagggatcggagtgtaagcggccttggacgtgatggccggtctttgaccattgcgcccaaggtccttacacgcagacttctgcgctggggagcgcgttatggtgtgagctgccacgccgacaaaagaaaaataatggcatcatataaaaatattttatcacttctgttaggtttgactatagtttttgcggcggcgtatcgtctcctcttgtaattaaaagttgtgtccgatttaactggcacaaaaaggagtgtggactttgaaatatacaccagaacagatcctgaataacccatttttaaataaagggactgcttttacccaggaggagcggaaccaatatggcttgaatggtttgctgccaccagctgtacaaacacttgatcagcaggttaagcaagcttatgcccagttgcagaccaagccaactgatttggctaagcgtcaatttttgatgaccttgttcaatgagaatcatgttttgttctataagcttttctccgagcatatcaacgaattcatgccaattgtttacgatccgactattgccgacacgattgaaaactacagtgcgctttttgttaatccacaaaatgccacgtatctttcaatcgatgatccggaccatatcgaaagcgcactgaagcatagcgcagatggccgcgatattcggttgctggttgtaagcgatgctgaaggcattcttggcattggcgattggggcacacaaggtgttgacatctcagtcggtaaattaatggtttatacggctgctgccggcattgatccgagccaggtcttgccagtggtcttggatgtcgggactaacaatgaaggtttgttgaacgacgacctttatttaggcaatcgtcacaagcgcgtatacggtgaaaagtatcaccactttgtcgataaatttgtcgccgcagcagaaaagctgttcccgaacctgtatttgcattttgaagactttggacgcagtaatgctgcagatattttgaatcaatataaagacaagatcactactttcaatgatgacattcaaggcaccgggatcattgtcttggctgggctattaggcgccatgaatatttccaagcaaaaattgaccgaccaagtttatttgagctttggtgccggaactgccggtgctggcattgcttcgcgagtttacgaggcctttgttgaagaaggattgagcccggaagaagccaagaagcatttctacttggtggacaaacaaggcttgctctttgatgacatgacggatttgacgccagaacaaaagccgtttgcccgttctcgcagcgagtttgctaatgcagacgagctgacaacgcttgaagctgtcgttaaggcagttcatccaacagtcttggttgggacgtcaaccgttccgggtacgtttacagagagtatcgtcaaggaaatggctgcccacaccgatcgaccgattatcttcccattgtccaatccgacgaagctggctgaagctaaagcagatgacttgatcaagtggacagatggccgtggcttgattgctaccggggtgccggctgctaatgttgaatataagggtgtcagttatgcgatcggtcaggcgaataatgcgctggtttatccgggcttgggcttgggaaccattgcttcgacggccaaactgttgacggactccatgatctcggccgctgcgcacagtttaggcggaattgttgatccggatcagccaggtgctgccgtgttgccaccggtttcgaagctcgatcagtttagccaaaccgttgcgattgctgttgctgaagacgccatcaagaatgggttaaaccagcaaccgatcagcgatgccaaacaggctgtggccgacatgacctggaagccggaatatcagccattaccggattcaattgaactagacttggaggaatagaactgtgactgcattaagtacatccattcaaagtgtgctgaccatcgttttgctcattgccgtgggttatgttttacggcggcaagggcggtttgatgatcagtttggtaaaaccatctctgatttattgatgaaaattgcgttgcctgcttcgatctttatttctgttttgcaacgactgactttaaacaagctggtaagtctgtcatccggcttagtttacggcttcggtgccgttattcttggctatctgattgcctttttgctggtttggctgcttaaagttcggccaggacggcgtggcactttcatcaacatgttcgtcaacgccaacaccattttcatcggcttaccgttgaacctagccttgtttggtgacaaggcggtgccatatttcctgatgtattacgtggttaacactgtttcaacttggacagtgggtgccttcatcatggcatgggatgatccgactcaggaaaaagcagaaaaaagcggcgccagctttaactggaagaagttattgccagcgccattggttggtttcctggttgcgttagtctttctgttgcttaagattccgtttatccacgttggctggttaggttttgcagttaacacgctggattatgttggtagtttggtaacgccactatcattgatttatatcgggattattttagctgatgccggattaaaggctatccggtttgatcgcgatacgattgtggccttaattggtcgttttgtgattgcgccagctttgattactggtttgatcttgttgggcatgcacgctggcttcaatgtgccgggacttgaagcccaaacgctgatcattcaggcggcggcaccaggacttgcggtcttgccgattctggcgactgaagcccatgccgatgttgaatatgctaccaacgttgttacaacttcaaccgtcttgttcgtggtcgtcgtgccgattctcatgatgcttgttcaaggtttggcataacgttaatagtttgaagtgcaacaaaaaaagagccagctggctctttttttgttgcttttaatgttgatgggcttcgagataagctaaagcgctggtatagtctggctcgtgggtttgttcagtgatcaactcgcgatacttaacggtgccggtgtcgtcgataatccagacactgcgggcatcagtatgattgtcagcaacaaacagtcccatggctttcccaaagtcagcattttgatcggacagtagctgcattttcttgacgttctctgcggcgcaccatgtttgctgttcttgtggggtgttagtcgaaatagtataaaagtcgacgttatcaaacgcgtccatgtcttcgttgaagtgtttggttgaaatactgcaaactcgcgtgttgatgtctggaacaacactgattaacgtcaaacgttgactaagatcctgtgtggttaaagaatgaccttgggcatccttgaccgtaaaagcgggtaacttttcaccaattgctgttggggtaccgtttgtcatgatagcggtgccgtgacgagttatttccatcagaattcactccttgtattgtgtgctgagcgtaagccagacttttgggctggcttacgcgtcatgtgcgtttcccggcggattgggaaattttgaaacgccggaagaacacaggaactgaaactactttgctcaataataacgcctgacacccttagtttaacatgaccacatactaaaataaatgtgcacaatctaattgcaacatgtcgatcagcatataaattgacgcgaatataaatatttatgtaaggttaaattaatggcaaatagcagtccatggttattgctatcctaatgaatggaactcgcgcaagaaagtggcaaagggggcggtcaaatggagcagacattggtagtctatagttcagagacagggtttacgcagcgatttgccttatgtatcgcgcaaacgttacattgcgaaatgattgatgtacagtttttgaccgcttcagatttaaagaatcggtcattggtgatttatggcggccatcttgttggcaataaagtgttgggattaaaatccttttatcgccaatttaaagaagatttgcctgagcagtttattgtgttcggtagcggagttgttcggcgcgaatccgtgaattgtcaacagattgcgcagtatcagcaggagcatcagtgtcaatgcacccgtttctattatctgcaagggcatccaaaactgaatcaaatgaaccttttttggcggattcgggctgcgtgggcattaaaacgctacggaagccgatcctgcccagcggttcaagacgccattcgtccgctagtttcggatgtgactcaggtattgaatcgctcatttgctacggatatcgttgaaaacccaccgttgtcttgacttcagtgggttctgtgttttgtgagcgtgagccagcgtgcttagaagtcggggtgtaagtggcttcttataatccgatttctgcactggggaacgcgttatggtaaaacccgattattcaccctcggcaattgagtccaccaaaatatggaagtatctataaattgatgttggcggctcagtcaagataatctttcgagcgaaagcaaaagtctcggctaagttttttagctttaaggtcgctgctatttcgacaacctgatctaacaatgcacgtgcctttttatgctggccttggcgtgcgcataattcggcacgatggaactgtgcccatagagcaaactcagcgcttggctttttgtcgagcgctgtttctaattggctcagatacttagcagctgcttgattgtcttgccgcgtcagttccaacatgacctgattttccaataagttaaggataagtaacggtgcgctgcgaaaatggcggtagtggtgactacgcttgatggcaattgtcagtaagcgatgttgtgtttcagccggcatggcaatgctgaagatgatgaaaagatataaatcaagttcgccccaattgtctagctgctggagatattgttccgcgacatgggtaagatcgggtcgcactggcaacttatgcgcttcatcaatgaccaatgactgaaaaaagacaggcaaaagcatgcgcgcgttgacagctagtttatttttgagcgtgggtgcttgttgaaagcgggtttgcgcttgccggacgttttccttcattttacgcagagtttcggggaaatcctgggggttggctgacattgtgagggacgaaccaaaataagcctcaagcatccgatcacgattaccgtagtccatgtcaaaatcatcagcggcaatatataaaaattcttccggtgtcgtttctaagcgttccagcaggtgcaacagtttcgtgaccgttatatcgttttgtccgcgctcgaccttggacagataggaactgctgatggtggcatcggctacctgcgcgagcgtcaagcctttatttttccgaatttgtctaagaagcgtaccgatatccatggacttcgcctttcatatatgacatttttcgtttccatcagcataaacctgactatattaaacaacaaggcatctgatcagatgaagctaaacaagatgatgggagcgaggacgatgttgacatggcgttatgggcgtaaatggcagttgctagtctatgcgattgcggctttgttttacagtatgatgaatgtaggggttgcctactgcttgacgatactgattcaggcggcatccgcgcgatctatggcgcagttggtgcaggcagtggtacccagtttgttaattttcttaggtgcctccgtggcaagctggctcgtgatgttcttgaaggccgtgatcacacgccgagtcaatttgaatattaaggcaagaatggcagcttatttgattgatgacgcagatctcgtcagcacccaatcatcagcactgtcgtttatgacgaatgatttaaaaatgatcgaaacaaatggcattgcaagcgaattggccatcattaatcagctgatcatctttggtggcgccatgattggagcgtttgcgtttgattggatgaccgccttagcctttttcctgggcaatctcattccgctaacagtgtcccgagttgctaggaaggggttgcatcgcgcgtcaaaagattggtcaactgccaatagtcactggacatcaggaatcaagaactatttggccgggcgtgataccattcggatttatcaggcacaggcggttgttaaaacgcgtatcaacaggctggcacgcggccttgaagatcagttgaaaaagatgactgttttgaccggcagtatgaacacgctgggcatgctattggcactttggttcggcgttttagccccttttggcatcgggatttaccgcgtgatgatcggcgcttcgaccttagcgttatttatgggcattgtgcaactgtcaaacgatatgcgtaatccgctgattatggttatcgaagcgatgaatcaatggcagacgaccaaaccgctagtcgcaaagatcaagcaagcacagcctagagccgctctgacaagtaaaacgccaatcaccgctggacccattgtacttaaagatgcatcggtaacacttggaaaacaaaagattttcgattcgcgcaaccttaccattaagcctggccaaaaagtgttgattatggcgccttccgggtacggtaaatccaccttgctgcgactgctgatcggcgagttaccgctagccagcggacaatattatcttggtaatgcccaaataacggcgacgactcgtacgcaattaagtcatttatttggcttgattaaacagacaccatttatgtttgacgatacgattcggtttaatttaacgttaggcggacatttttcccagacagctttagacaatgcggtggctgatgccggtctgacagcgcttattgcacaaaaaggatgggattatcaagttggcgaagagggccatcatttgtcaggcggccaaattcaacggcttgaaattgcccgggctcttttgcggcagcgcccgattttgttagccgacgaggtcacttctgcgttggatgaaaaactaagtgatcaactccatacccgactactgcaaagtcctgcaacgttaatcgaagtggcgcatcatataagtcagtcatggcagcagcgatacgatcaggtcattcaactggatgcagatgcaaaagccggttgaagcgggtgatggtgcgtgacgcgggtgcaatggagaatacaggtcaaacaaaaaccgcatgataaaaatgcggtttttgtcgttcttatgcctgaccaatttctttacttaatgcctcaatctcatcaactgtcgtccccaagaaactgattgcatgcttcaaagcggcgtctgtggtgacatcaacgccggcgactcgagctgcttcgactggatcaagtgagtcgcctaggctgagataacgcaaccaccgatcaacggctggttgaccttgttgttcgatggcctgaaacgcttgggtagcaaccgtcaagccggccgaataggagtacgaatataagcccatgtagtaatggctttgccgcatccaagtcagctcagcacctggctcgagttctactgccgatccccaaaaatcggtcagaactttacgcgtaatggcatccaaccgagcagcatcaaaagtttcgccgttatcgatcaagttatagacttcccgttgaaacgcggcttcgagcagatgagtgacaaagttgtggaaataggtatcatttaataaccgtgacaaggcaaagcgcttcattcgcggatctttagcgttttcttcgagatagtgagtcagcaacagttcgttgaaggtggaaggactttcgaccaaataggcattaaagtccgcatccaacacattgtgggcttcttgtgagcggaccatctgagcggtatggcctaactcgtgaatcaaggtgtaaacggcaggcagcgtattactccaagtcatttcgacataagggtgcactccatacggtccagcagtgtaagctccggaatccttgccttgattagcagggaaatcgatccaccgctctgagaaagcctgcatcatctgtgcctggtaatcttgacccatgagtgcggtggcatttttaatatcttctttggcttgttctagtgtgatggttggcgcataacttggatcaatgtcgatttgcaaatcggtataaccaatatgatcgagcccccaaagcgatttcacaagcgtcacataacggcgcatgatcggagctaaatcgttcatgatgacatcgatctgacggttaaacatctcgcgggtaatttcttgatcagcgagtagatagtcaataaccgaatcataaccgcgcatggtagccgtaatcttttcacgcgtgacttgggctaagtaacctgccgccatcgtgttttcataacgacgcaaggtctggttgaattgagcgtaagcggcgcgccgaatttcggtatcgggatgtttttgataattttcttcatacatgacaaacgataacgggtaagttttaccgtgcgccgtaaacgtaccaaagtccatatcaccaaagatgctttggtcgcgaatatcacttggagcctgaaaaaccggggtcaattcggctagcaccttctcggcagctggtggtaaggcaccttgtttggcaactttgatttggcgaataaaaccggcataatcaggagcggtttcgacaactgcatcaagcacgttttcgggaagttgcgtgagttcggctcgaaagaaacttagctgaccgctgatttcgccatcgagaccagttacctgagcctgccgcgtacgcaacgcaggatcagttgtatcagtggagtaaggcataaagccccaatgaatgatgcgactggcaagggctacaatggttccatagtcagctaatgcatccgcaatgacagctggttgtgtcaatttgccttgatacattctgacaaaatccttggtcaaggcccgtacctgctttactgcttcagtgtacgcaaaatcatcgctgaaaatcggggtaagatcccaagtcaactgctgatcgactgcttgccgttttggtagtgttgtctcgctcatgtaaaaagcctccttaaaaaagtgagcgcgaaccaacgcaggcttctgcgttggggaagcgcgttatgtgcgaatcgccgcgtttaacaccaggaaacgcactatagtggctaaagtatagcattgatcacgactaaaacgcatgcgcacgctagcaagttcagcatttttccaaaaaggtattggtacatctatgcttactgccggtaatagcggttcatcttgcgggaaaaataaacttaactaaagctaaactgccttttttcatcagctaccactcgtgtatactgaatatgaacgaatttactgaaaatattcaaggaatcgaggcacatgcatggcagaagaacaaactttagtcttggttaagcccgatggtgtcgcccaaggacatatcggcgaggtcattacccgcatagaacgacgcggattcactattgaggcactaaaagtcacacaggcaacctccgcccaattacatcagcattatgcagcacttgttgacaagccgttctttcccaaaattgaacgcttcatgaccagtggcccgctggtggcgatgattgtcagcgggtttaatgtgatcgaagccgttcgaacgatgacaggcgctacgaatcccggagatgccgcgccaggcacgattcgcggggactttggtcgggaatgggccgatcagacgattcgcaacgttattcacagctcagatagtgaagccagcgcgcaacgtgagattccaatttggtttgcagacaagcaatatgcccctaaagccaatcaatagccgctttgccctagttcattttaatagcatcatctgaaactgtatttgaagaaagcatccaaaaaggcagttgcgatacgatctgtgatcataccgcaactgccttttggtgtcatcggattaatgtagcaggtgcttttaagctgttagtagtaggtgcggcgattgccgaagtttaatttggcaatgatggtgttgggttccgtcatatccggtgattgcagccacaagccgcgggacgcgagctctttaaacagataatttatcgtggcaatttcttcagctgcagggtcgtcaattttggcaccggcttgatgcgcctgtgcaatggcatcgtccacggataaggtgagcgtatccgcgaatgtatcattcaaagtggcatacagtttgcctagttcatcgtccagataagcttctagtgcagtaaaaaaagcgccatgatcggctttacgatcaaaataccgcgctactagctggttgttgtcaatccccatctataacacatcctttttaaatgattttaccatgcgtcactgatcaaaagaaatcatcgttttttaaagctaggtgtagcttaccgccaattgattttagagagcacccgtcgaccgaggaattcttgaatcaagaggtaaaacggtacggttgaggccatgagcggcagatagagtaaggctaactgccaatgccataagttggcgagtgaaaaaataccgttgaaaacaaagaagacaagaaacagcgcgacactgagactcgcaagcaagccggttttaagccggttaaacgggcgcgcaacgactagcaggacattcaaggaaatggtcccgatcaacatggctaccatggtcgaagtggtatcgaaactgagatggaagaacgattccatccaggttaacagaagcgtataaacaacgatgctaatagctgctggtgccgcgactgtcatgaccttttgcatgaactggccggtgacgcgttcgaagttaggctctagggtcaagaagaaagagggaatggccaccccgatagctgaaaccggggtgagattgatggggacaatcggataatcgagcggcaaaaagacgaagattgtcgctaaaatgacggaatacatggtcttgaccagatacatcgaggccacgcgttcgatgttgttaatgacccgccgcccttcgtttagtaccccggtcatggcatcaaaattagaatccaacaaaacgaaatcagcaatcgaactggcggcatcggcaccggaagccattgcaatgctgcagtcactttgacgcaacgccaaaacatcgttaacaccatcgccggtcattgcaaccgtatgccccaaagcctgatatgccatgatgagctgctttttttgatccggggtcacccggccgaagacattgtattgtttaaccagcgtttgaaaatcagcggcggtggcatcagcaggaatggtgctcatgtccacactgcgatcagcaccttcaagatgggcttgcttggcgatgttagcgactgtggtcggatcatcgcccgaaatgacttttaaagccacgccttgggtcttgaagaaatcaaacgtggtgatggcagtcgggcgtaattcatccgtgatgagaatcaagccgattaactgcggattaaccaaaggctgggtaagttgggtggccgttcccaccgcaagcacccggtagccatttgccgcagctttttgaatcttagccgttatggcagctggcagttgatcaccaaatgtaaattggggcgcacccataaacaaggcctgtccatccacgacggccccggaccatttgcgagctgaagaaaatggaacggtctgggtgacttgttgattggtatcggcatcggctgcagctttgattgccaaagccgtttcattgtcatcgttgagtgcgtagacgatcgcagcggcggcgcgggtgacatctttagcggtccgcccgtctgcaggcaatgtgtcggtgactttaagcttgccgctggtaatcgtcccggttttatccaaacatatcgtgtcgactcttgctaaagcttcaatggccggtaatgcccgcaccaagacgcgcttgacagcaaggttgcgtgcagaaacagcgagtgcaacgtttgttaacaaaaccagtccttcagggatcatcccgatcatggctgcactggtggtcaaaatcgcgcgattataatgaccacgccgaatcatggaaaccgtgaaaagaatgacgccgataggaatcaaaacataggttaaaactcgaatgatgcgattgatggtggctaatagctggctttggctgaccttttccgccttagcttctagcgctagtttagcggcaaaggtagcgtcaccgacagcggttacttgcatggtagcctgtcccgatacaacaaatgccccggagagcaaagtgtcacccccttttttggcaatggggcgggattcaccggtcagtggactttcatcgctttcaaggccgttggtagctaccacggtgccgtccaccggaatttggtccccgcgtttgaggatgaccatatcgtccataaccagttgctcaagctcgactttttccacctgaccgttacggatgactgtcgcacgggtggcagcaagaatcgacattttgtcaatttggtgcttggcttgaatctcctgaatcgtaccaatggcagtattgatgatggcaacaccgagaaacagtaaattcttatagctgccagtcgtgataatgagcgcacccaacacgacattgaccaaattgaataaagtgaaggtattgactttgatgatctggctaattgatcgtgtcagtggctttagtggcaggttgtgttggcctgcaccgattcgttgctgaacttgttcttccgataacccttgatcaggtgaaatcttttgctctgccatcgcatgccctccagtacttttcatccattttaccaatccagacaacaagatgccgaatatcacacttgtttttacaaaactttgaagttgttggcgtggttgggttatggttagggagtcatgaaaccgtcataatgagatcaaagttatagaaagaagtgctctcatggtaaaacgaaacccaaatggaacccgatttatcacattacctaatggctaccacttgtggacccagacattaggcagtggcccgattcaattactgacgttgcacggcggaccaggctgcacgaatgaagtgtttgaaaattttgctactgaactggcatcttttggtgtccgtgtctcgcggtacgaccaactgggttcatttttctctgatcaaccggacttttccgatctggctaatcaaaagcgttttctcaatatcgcgtattatgttgacgaagtggaaaatgttcgacaacagctgggccttgatcatttttacctattaggtcagtcctggggcggtgtgttggcgattgaatatggcttgaaatatccgcagcatcttaagggacttattttgagctcgatgattgataatttggatgagtatttggttaacattaacaagattcgggagaccatgttttctagtgatgacgtggcatacatgcaacggattgaagcccagcacgcgtttgcggatgctaaataccagcagttggtgcgtgagttaggggagcaatatcttcatcatgccaaagatccccagccgcgccatttaattagcacgttggcgacccccgtgtatcattattttcaaggtgataatgaatttgtgatggtaggcgcacttaaggactgggatcgacgggctgatatacaccgtctgacaatgccgacttatctgacgttcggtggacatgaaaccatgccgttatcagctgccaagcgaatggctcagacaataccaaatgccactttgcatgtcacacctaatgccggtcatggtcagatgttggacaacccgacagattatttcagtcatttgggtcagtggcttgtgaaaacggatgctggatcacctttattagataattaacgttataatataaatggtaagtatatgtctctcatgtcatggaggtgctttcatgtctgattttgatgaattaaaagaagggctgcttgaaccggttcatgcctttgatcacgcactggagcaacaacccgatttgattattccgttagcagtgattcatttgattcccattgcactgactttaggcggcggcattgcgatcattcgcggtcaccagaaattacgcgcggaaaaagaacgaaccaagcaattgagcctgaagctggaaatgcacaaacgtcatcatggccggcatccatggcgactggcaccagaacatcgtggcgcacatgaagtgtttgcaccggaatatgcagaagtaccggttaataaaaaacatcatttgcatcacaagcattaatttgtattaggtgatttgctttgaaacgactcccgccaataaacccgcggagtcgtttttcggttggggggttcttgcatactctcgaaacgcgttcgccagcccagaaacctgcgtgtaaggaccttgagcgtaatggccaaagcccggccattacgctcaaggccacttacactccggtttctaagcgggctggctcaacgctctttttactttcagattgaatctcgcgtaaagttgggggaaaatgaaggacacaattatgttttggagatgatgtttgtgtcaaccatatttatgcgggttgcgatgcctgctgatattcctgcaatgatgaaagttatcgcgtctgcgcgtcagtttttgggcgcgcagggaattgaccagtggcaggggacttatccggatcaggccgcgattgagcaggacattgctaccggtatcggtcgggttttgattgtggatggccgggttgccggagtggctgctttagttgtcggtccggatccgcattatctcagaattgatggggcaggctggttggcagatgtcccgtatctagcagttcaccgatttgcgcttgacggtagtattcgcggtaaacagttgagtcgggtattttttagcaacattatgagtgaagcttatcggcgcggttttgacgatttgcgggtggatacccacgcgaaaaatgtgatcatgcagcatgcgattacaggtatgggctttgattttcgtggcatcgtttatatggacgaaccggttcctgaacgcaatgcctatgaagttcggttaacatcggtttaatggacgcaaacatggagggtaaagatgcaggacattggtaacttagcacttattttggtaacaacattggtattggcacacgtgagtcggttgctgaaaatgcccgcagttattggcgaattattagcaggaattttaattggaccggcacttctgggatggatttcgtctacgcatacgatttcactatttgcagaaatcggtgtcattattctgatgtttttagctgggttggaaagtgatctggagttattgaagaaatactttaaacccggtatgttagtcgcggttatcggcgttattgtgccagttgtcgttgtctttggctttgcccatctttggggatttaacttgaccagcagtctctttcttggcattacatttgcggctacttcggtttctatctcggttgaagttttaaaagaattgcatgccttggaaggtcgcaatggggcaacgatcttaggggctgcagtcgtagacgatatcttgacggtcttaatcttaagttttacggtcgcagtattaggggaacaaaaaacaaccagtattccgttttggctgcaaattatcgagcaactgttgtactttgttgggatttattttgtggtcagatgggcggcgccgtatttaatgcggttgtctgaaaaattattcccggcttctgcggttaccattatgtcgttattgatttgccttggaatggcgtatgtcgccgatcttgtgggcatgtctgcagtcatcggtgctttttttgccggagttgcggttgggcaaacccattatcggcatgaggttgatggcaatttgagtgcaatcggatatgccgtttttattccagtatttttcgtgagcgtcggcttgaatatgcgttttgatacctttggccgtgatttgggcttcattgccattttgacggttttggcattggtgaccaagtgggtaggctgtggccttggcgatcgtttagcaggcgctagttggttacaaagcaatgttgtgggagctggcatggtgtcacgcggtgagatggcgctcattgtggctcaaattgggtttgaggccaagcttatggacgcagaatactattccgccgtcattgtggttattgtcatcacaacgttaattgccccggttattttaaaagacgcactacaccgcgaacaggaacttgtataatagagagcgtgaacaggagcgcatagaaatcggagtgtaagtggccctggaccgaaatggccggtttttggccattttgatccagggtccttacatggagatttctgcgactgtgagcgcgtttaaggagagagcgtgaacagaaacacatagaaatcagcgtctaagcgctcatacctgttgtcggcgttactaatagacgacacttaatggcttttttttacagcctttcattcatgtcaaataaggaggatctcaatggcaacattattttttgattttgatggcacggtagcagattcagaagcaggaatcgttgcagcattaaagtacatggttcaggatcgcggattgcgtccgttggataattcagcctatgttcaatttattggcccggcgttggtgcaaaagcttcctgaagtctggccggaattggatgatattgaagttaagcgggcaattgatgcctttcatcactattatcaagaggaaggcttatatcaagctaaactttatcctggctttctagatacgatgacggcattgaaggaacaaggacaccatctttatattgcttcggctaaacccgagatgatgctgcatcgccttgttaaacactttgccttggatcgttactttaacgctgcttatggggcaagtgacgatgagcagacgcgcgtcacgaagacggatgttttggcctatgccttaaaagaaaccaatgaagatcctgctaaaagtgtcatggtcggggatcgcgcgaatgacatgattggcggcttggacaatcacgttcagttactcggtgtgacttatggctttggatcagccaaagagctagaagacgcaggagctaaggtgcttgtcgataaaccggaagcaattccttcaggcttggcaaaattggctaaataataagcgttagataagtttgaagctattaaatccctgatggcatcacgatagggagacaaaaggcgaatgcattttccatatgtgcggagaatgcattcgcctttattcagtcattagcgattctttttagcggcttgctgtggccgaatgaccttggaaccaatttcattcaataacttcacgaactgttttgctttgcgttcgcctaatgctgcgacccattcgttgaactgctcattggcatttttcgtaatggccgcttcgacctgtttgccaagcggcgttaactgtagcatattgcggcgccggtcagcttcaaactttgactgggtgacgtaattcaagttgcgtaaaactcgcagttgacgggctaccgcgggcttggttacgccacgcttattcacaattgcagttaaactgatttccggatcattggcaatgtccgataaaatccgatattgctcaaaacttaaatgatacgccgccattggttccgagatcagttcattgatattcttgaacgttgaaaaataggcatccacatatgcctctagtaagggtttatcagtcatatttcttcctccgaatattagtttaacaaatcacgggtcacatgtaacttgaaattctgaaaagttgcggtacacttttcagttatgtaaaggtcttgaaccacttatggaggttaataacgtgcgaaaacataaaaaagcttggctgatcggtattctgtcggtcattggggtgatggtggccgggctggtgggtgccagcttatatttttatcagtatgcctttgttccatccaagaaatctttcttgagtgggaaggaaagccgtattattacggatagtaaagtatggcttaaatctgtacataaggaaacctggactgaacaggcagccggcgacaagctcaaattagtcgcggattatgtacccgcagccaaaccgaccaataaaacgatcgtggtcgcgcatggttatatgactaacaaagaatacatggccccgcaaatcaagatgtttcacgatgccggatttaacgtcttggctcctgatgatcgcggccaaggccagtcggaaggaaactatatcggttacgggtggccggatcgactggactatctcaaatggattaaccagattataaaaaaacaaggcaaacagagtcagattgccttgtacggggtctcgatgggcggggcaaccgtgatgtatcttagtggcgagaagttgccgccgcaagtgaaaagtatcgttgaagattgtggctataccagcatcattgacgagcttgcttatcaagccaagtcaatgtttaatatcccgaagtggccgttggtaccggcagttgcgctaactgcgacgctcaaagccggctacaatgtttttgatgccagtgccattgacgctttgcacaaaaacacccgaccgattttattcattcatggcagtaaagacacctttgtcccgaccaagatggtttatcaaaactatcgtgcggccacaaaatcgaaaaaggctttgtgggtcgtcaaaggcgcggcacatgcccgtagttttccggaccatcagaaggcttataccaagcgcgtggttggctggttcaacgctaattggtaaccgttgtatgtctgcttaatgggtggcagtatgagcaacacgggttaagacggtgtaaatttttttggcatcgcttggtgttccgcgcaactcgtaatcggccaaaaaaggcgcgtcgaattccttggcgtagcgtttggcggtcaaacaatattgttcattgaaattgcggttgccagaaccgatgatgcctagacaaagcttggcattgtcgccttctgccagatagtcacccatggcattggtcatcagttccttgacgccgttatcaatgccgttaccaccatcgagataggtgggtaccatcacaaagaacggtttcgtttcgccgtcactttgcgtcgcctcggaaatttcttttagaacaatcgctggattttccggattctgatcatgttgggtttgtgcatattcggctagacgtttagcaaatgcgcgcgtgttacctgaaattgaaataaataagatgcgaataggttcagtcatgtggcctgcctctttcattagagttttgaaaataacaatgatgcggctgatcgtcaaggtgagccggttagaaaaagaagtcgcggtgctgtcactgatagcgccgcgactctttttaatgaaatggatctgatgcaatcgatacttgttgccaaaatgagctggtttgcaacattagaattcttgatagaccgctggatcctgattgtttaagcgtccatctgatttagttaatgcgtcaatcgcagccatttcttctttagtcaggctgaaatcaaaaacatcgagattcgtgcgctggcgggaaaggtgggcagactttggaatcgggagaatgtggtgttgaagatcccaacgcaaaataacctgaccaacattcttgccatgggttgcggcgatctgtttaatcgctggttcttgcaaaaccgctccccgccctaaaggactccatgcgaccgtttgaatattgtgcgcgtcatcatacgcgcgttgttcttgctgattgaaatagggatgcaattcaatctggttgactgctggcgtgaccccggtttccttgatgagccggtcaatatgctcaggcagaaaatttgaaacgccaatagaccggatcagtccgaagcgttgtgcctgaatcagcgcttgccatgcttctagataaagatcctctttcggattcggccagtgaatcaaataaaggtcgtagtaatctaaaccggctcgatataggctttcttcgatggtatcaatcgcctcttgataacggtggtggcgtcccggaagtttagacgcaacaataagctgactacgtgggatcccactttgacgcactgcttcgcccacagcaccttcattttcataattaaaggctgaatccaacaagcggtaacccagattaagggccccaaccatggctcgaaccccgttagtcccggttaatttatatgtgccaaaaccaatggctggtaaaacattgccgtcgtttaatgtatagtgcatttgagaaacctccttgtgaagttgtgacccgatgcaacaccgaatgagtacatgtgaaagtgaggttgccaaccagcgccaacaccagcaatcatacggcgaaaagcaatttaggatgatggcttaatgatgaccgacatgcatcaccattaagtgtagtccaaatgtcaggaagcgtacaagtcatgatgacgcttcgtgtataatagggccagatgcgagggaggggatccacacgagaacacaacaatggcgaggcgtctcccgtagttggtttgcattatttacgctgatcttttgggtacttctttttgttgaagcctttagtaccggtatgatgttgaccattgggacacccgcacgaacagagcaaatcgttgttaaaagccaaggtctgcaacaactcacggatactttaaaccatgatctggtgacaacggcgaaccaaaatggcgctgctttgaatagtgacactaaactggtcacacttgatgacactcagcggcttgccgtaaaaatgatcacggccagtgcagctaaccaaacgcatatttcactggcaaccattaaagaaagtctgacgagtcggcttcagacagcggcgaaaaatcaaggtcaaaattttgacgatcaaaaagtgttggcgagtctcaatgccaaacttgaatatgaaatcaatgagtcaatcatggagcaaggctgggggcttatttatccgttgttggtccttatgacccagacagcggtgattgtagccgcaattttgctggtgattgttctgctcattatgttaaaaacagcacactcatggcggcggtttatggccgttgttgggcggtcgacttacgcaatggggtattttggtggtttcatagcgattcttgtaactgcgagtccattgttaggcatgattagtacgcgggcaccgttaaatacgcaattggcgagtgatttaattcgtgcatactcaccgctatggcagcgagtggcaggttggaccattgtcgttggtttaatcattgcggcaattagccatttcttaccacgtcctgccttgcttgcagatgattcggcgaacccggcagcagaaaggtaggttccatgaaacgaaacaactggatttggttgggcttacttggcatagttctggttgtcagtgcaggttggtattggttccacaaccagtccgtcaacacatccgatcaggagcaggcgtcgattggcaaaaccgcaacgctttatttgcatggctattccggtggtgccgggtcgaccaacacgttaatccgtcacgctaaacaggcgggagcaaccaaagtccttactgcaacggtgagtaaaaacgggaaagtcagttggcttggatcgcctcaccatgttcgtaagccaattgtgcaagtggtctttgaagacaatcgcaatccggatgccgtgaaatgggctgattggctagcgacggttaatcgtcagctttaccaacgttatggtgtgcgcaacgttaactttgtcgcccactcaatgggaaatatggcggtgatgttttatgcaattcgcaatcaagaccagcaaaaactacctaaaataaacgcctatgttgccattgccgggcattttgacggtatcattggtatgggcgatcaaccacatcaaatcaagttagctgctaacggctatccatccccgttagacgaaaattatgctgagttggctcggatgcgcgatcgttttccaaaaggggttaaggtgctgaatatctacggtgatcttcgcgatggttccgattcggatgggcgggttagcaacaactcatcgcgatcgttacgatatctggttagcccacgcgcagccggttaccgggaaagagaatacttcggtcgcgatgcccaacacagcgcgttacatgaaaatcctaaggtcgcccaagcggtagatgcttttctctggtgagactcacggttaggtgcgatcgtatggtgacacaacaacgcgtccaccgagaaaactggccatatagacatcaccgggttcgtatccttgctctgccaagcgagccttaagccatttctcatcatggtcaatggcgtcaagtgcggccgggtcaatttgcccatctaaaatgagtggatatttgatggtttcgtcgccttttaaaatgacatttaactggccattttgttcaagataagcctggcgaacatcgcgtaaatcattgacgccggcagctcgtagtttataagcaaggtcgttagcagataagcctacccgtgtggcggtatccactttgatttgaccatgttgaacgactaataacggttcgccatcaatcacccgtttgagccaacgattgtggttcgtcaggtatttagtgctgaaaacgattaacgtccagatcagcagcacgttgacaaactgcaacagaccgatatcggtattataaataacgccgccgatgatgccgccaagaacgtaattctgcatttgatcgacaatggttgccggtgcaagattacctttaccggtgagcttgatttgcgcgatgaagacaatgaagcccaaaagcagcttcattgccgtcacaaagtatggatcctgaaaaagtcgcatatgaatctccttatttagtgatgaactgagcttttggcacaatcaaggtcgttttagataactggtaactgttattatcggcattaattgtgacggtgtacatttcttttgtggagcggccgatggtgatcagcatgccggtgtgaacagtattgctgttggcataaagctgacgggtggcgacatgcttttgggttgccacgctgcgtaacagggtggcaacggcttgggaatcagcgttggccgttcgactagcctgaagatcgcgaacttggatgccgatggtcaggagttcaactaaagcaactagcaccaaaagatcgcggtatttgttactgcgtttgtggcgtaagaaatacagaagataggcaataataagcaaggcaccgattaaaataatggtatatcgtaaggtgctttgccaactgttctgctgggttagcacggaataagcaaaaaaggtagttcccatagtgcacctccataaatcatggtctgatcaaatcataacaagaataatagcgagggtgaagttgttcttgacatggcttatcgcggtgttatgatgaattcaatttatgacaaacacattgctttgcggagaagagtaaccgaagcgcagatcgacagcgagcctggacagtgtaagcaggtgatcggctaatcggtgaagatgagctccaaatagcttttcagtggttcacgccattgaaacgggtgcacccgttatgatgccaggtatcagttttggtactgttgaggtgttaatgttaaattaacacgaataagggtggtaacgcgcaccgtcgccccttgatcggattcgatcaaggggcttttttcgtcccgtgacggctatgacttaccgcatcagtcgagtgtgttgcataaaggtaccgactagttggttgttccattgctgcgtgttttcagtggtggaatattaatttgtagttgattttgcgtaggcatccatttttgaatgtgatggttattcaagactgtagtgcgtttgccatgacgcgtttatagggatagagatctgacctacactccggtttctaggcggccctgttcacgctcactttctataacgcgctccccagcgcagggatctgcgtgtaaggaccttggtcgcaatggccaaaaccgggccatcacgcccaaggccacttacactccggtttctaaccgggctggctcgcgctcactttccataacgcgctcacagggccagaaacctgcgtgtaaggaccttggtcgcaatggccaaaaccgggccatcacgcccaaggccacttacactccggtttctaagcggccctgttcacgctcactttcttttaggagggtttcacatgacagaagaagttcaaaccaaagccccttttcgtgctgatttagttggtagtttgctgcgtccggagcggttgaaggttgctcatcagcagcttgggatcggtgagattcagcaggatcaggagctggcgattcagcatgaagccatcaaacatattgttaaaaaacaagtcgaactcgggtttaatgccgttactgatggtgaattctcgcggcgttactggcacctagactttttctgggggctgaatggctttgaaaaggatgatgcatggaagtatgaacgggactttaaaggcgggattaatcctgctgccaatgttcatcttgctggtaaggtcagctttaatcccgatcatcctttctttgccgcctttaaatatctcaagagtattgtgccagccggggtcttgccaaagcaaacaattcctagtccagcgctgttgtttagggatcatcgcagcgataactggtcgaagtactatgcttcttttgatgattatttagctgatgtggtgcaagcatacgtggcaactattgaacacttttatattttgggtgtccgttacttgcagattgatgatacgaattgggcttatctgattcaaaacctaaaagatacagagaacgacccgaaacgacaccagcattttgtcgactttgccaagctggcgcatcaggtcattaaagcagtgttaattcgattacctgaagatttgaccgtaacttcgcacatttgccgcggaaatttccagtcgactttcttattctcgggcggctatcagtatgttgctgatgaaattggcgacttgccttatgacggattattccttgagtatgacagtcagcgtgccggttcgtttgagccattaccgcagctgtggcaaggcgataccaataagcggattgtgttagggttgattacgtcgaagtttccggagttagaagacgaggaaaaagtgattgaacgtatccatgctgcgactgcttatgtgccactgagcaacttggctttgtccacgcaatgtggttttgcgtcaaccgaagaaggcaacaagctgaccgaagatgatcaatgggcgaagttggccttggttcagcgtattgcgcatcgggtttgggaagatgcttaacagataagccggctagactcaaaattttttgaccctatttggcatgatgtcatgtcattctcagatttttttcacaccggtgggattgtgttatatgatgaataggtaagctattgagaaggagatccttaatttatggcaaaagttgaaagctttacgttagatcacactgcagttaaggcgccttatgtccggttaattaccaccgaaaaaggcccgaatggcgatgaaatttctaattatgatttacgcttggttcagccaaacaccgctgcgattgatactgccgggttgcatacaattgaacacttgttggcatcattattgcgcgatcgcatggatggcgtgattgattgttcaccgtttggctgccgcaccggctttcacttgattacctggggaacacacagcaccacggaagtcgccaaagcgctgaagtccagccttgaagcgattgctaacgatattacctgggatgatgtacccggtgttgacattaagagttgtggcaactacaaagatcacagcctgttttctgctaaagagtgggcaaagttgattttgagtcgcggcatttctaacgatccatttacccggcaggttgtctaatctgacgagcattgattagaaccaaaaatggcactgcacaagttcgaatagcgaacctggcagcgccattttcatgtcaccatgtttaactgaatagatcaatcaaccaccggccaccatatagcaaactcatgctataggcgaagatggtaatgggtttgccgagtataataatccagaagaacctggtaaaggtcattttggtgagaccggcgagcaaacatagcacatcatctggggcaaccggcaacacaatagcaagggtaaacaggtgatcaaagcgggtctgattcttagtgtagccgatgtatttttcataagttttttccgaaattaaatacgtcagcaggggcttgccaaaacggcgggcaagaaaaaagttaataaaagatccgatcgcgatgccgatgtagttgtagagaaaaccaaaccacgggccaaaaagaatcacacccgcagcggtactgatgccgcctggaatgatgggaatcacgacctggatgacttggatgacaacgaaaaataaagctccggttaagccgagtcgggcaatgtaactttgtaaaaccttgacatcagaaagaatccctagatcgtaccaataaatagtgacgacgactaaagcgatcacaacgatcagggtggcaagattgatcaaatggcggacattttttggagtcataacgttaagcctcagaacgatttatcatcaagaaaagttctatgctacaatgagtcaagcgtaccaaacatatgtactgaatggagagcttatgtacgaatactttgaaggcacaattcaggccgtaacgccggcgtacattgtcattgatgtcaatggcatcggatttcgcctgctggtagccaatccatacgatttcgaagcgggaaagcagacccggatttatgtgcaactcatcatccgcgaaaatgatcaaacactttacggatttgaaacagcagcggataaacgaacttttaaccagttgttatccgtcaccggcattggtccgaaatcagcgttggcaattttggcaaatgtttcaagtggtggcctagcaactgccattgcccaggatgatgttaaatttttgaccaagtttccgggcatcggtaagaagacggccgctcagattatcctggatctaaaaggcaaaattacgaccgatgctcaaccggctgccgcaacgatcatgccgaccgccgatcaagtagcgccggagctggcagatgccttggctgcactggttgccttaggatacacccaacgcgcggttgatggcattaccgatgctttgaaagcctttgacgccacgacgaccgatgcttatctgcgtgaaggtttacgcttgttgagcggacgagcataacgttgattatactggagcagcaggacatcgacaacggtaagactttttcagacaatatagaaggggcgtgagtttttgccagacgcaaacaaggatcggttagtttcaggcgacattgatgatctgaatgaagcacaaattgagaaaagcttacgtccacggcggcttgctcaatatattggtcaggatcgggttaaacatcagctgaccgtttatattactgcggccaagcaacgtgaagaatccttggatcacgttttgttatatgggccgccgggattaggcaaaaccacgctggcactggtgattgccaacgaaatgggcgtgaatatccgtaccacttctggaccggccattgaaaagccaggtgatttggtcgcgttgctgaatgagttgcgccccggagatgtgttgtttgtcgatgaaattcaccgattaccaaaaattgttgaagaaatgttgtactcggccatggaagacttttatattgatattgtcgttggccagggtccgactgcccatccggttcatttccccttgccgccatttaccttgattggggccacaacgcgagctggtatgttgtcggcaccattgcgcgatcgatttggcattagtgaacatatggcgtattattcgcctgatgacttaagtgagattgttaaacgctcagcaaatgtcttcaatatggcgattgatgcagaaggtgcctacgagattgcgcggcggtcgcggggaacgccgcgggttgccaatcgcttgttgaagcgtattcgggattttgctgaagttgccggcaagagcccggttgacttggcaatggtcgatcatgcgcttgatcagttgcaggtggatgcccaaggacttgatcagattgatcgcaagttattaaccttcatgattcgtgactaccaaggcggaccggttgggttatcaacgattgctgccaatatcggtgaagaaatggctacgattgaagagatgtatgaaccctacctgttgcaaatcgggttcttgaaacgaactcctcgtggacgcatggtgacgcccgctggctttgcccatatgggaatgacgatgccgcaatcctcagacgagcagtcgccatcaaaaaacaactaaatgaaatgaatggaagcgaacaagttgcaagacaaaaaacgttatcggcgcgtagaaaataaagattatcaactttcggattttgattatgacttaccgcatgaattgatcgcccaaacaccgctgaaagaacgcgatgccagccgtctgttggttttaaatgctgatactggcgcgatgcaggataagcatttttatgacattctggattattttaaaccaggcgatgcgttggtcatgaacgacacacgggttatgccggcacgactttatggtgtcaaaccggaaaccggtgcccacatggaagtgctattacttaataacacttccggcgacgactgggaaactttgatgaagccagcgcgcaaggcaccagtcgggacagtgattgattttggtgacgggttgttaaaggcgacggtcaccaaagagctggaacatggcggacggatgatccattttgactatgatggcatcttcatggaaattctggataagctcggtgaaacgccgctgccgccttacatcaaagaaaaacttgaagatccggaaatgtatcaaaccgtttattccaaagagctaggatcagcagcagcgccaactgccggattgcattggacgaaagagttattgcaaaaggtgcaggataagggcgttaagctggtttatctgacgctgcatgtcggtctcggaacatttcggccggtggtagaagaaaatattgaagcgcataagatgcacagcgagttttatcgtctaacaccggaagcagctgcaactttgaatgaggtacgcgataacggtgggcgcatcattgctactgggacaacctcaattcgaacgcttgaggcgattggcactaaatttgatggtgctatcaaggcggattctggttggacagatattttcattaagcctgggtatcagtggaaggtcgtggatgcctttatcaccaacttccatttgccaaagtcaaccttggtgatgttggtggctgcgttcacaggccgggatacgatcttgaacgcctacaaacacgccattgaagaaaagtaccgattctttagctttggcgacgcgatgttcatttattgatgatcgatcatgtgacccgctactgtctgcgggtagtttacgccattgatcgtctctgaaggtatataaaaaccggtttgcgcgtttgcaaaccggtttttataacggacgggatcacatcaacacataccaacagacatgtctcgatttttcttttaacgcatcgctgcgtggaacaacgtattcatagacgatcacaatggccaggtcaaaacccgggaagtgcgaaaactacggtaacggtgatcccgtccttagctttattttaacaggaaaaaccagtagaaaaaaggataaagctcggtgatcgtgggccagcgctttataagaaagttgttgatcatctgctggacaggtttcatttgtgaacggtcctgcagcgtttgggcgagtcacttacttttaaatcacaagtaactctgttaaactggcataacgagaaaatggataagcggtgctgcgagggcattgctgtgaataaggagtctgtatggaaccagcagttaaatatcgtctcattcatcaagataagcatagtggtgcccggttaggtgaattgatcacaccgcatggaacttttccaacgccgatgtttatgccggtgggaacccaagccagtgtcaaaacaatggcgccagaggaattggacacaatgggagcaacggttattttagccaacacctatcatttgtggttgcgtcccggtccggatttaattgaagaagccggtggattgcaccgtttcatgaattggcacaagggaattttgacggactcaggcgggtttcaggtcttttcgctagcagatacccggcatattacggaagacggggtcaccttcaagaatcatctgaatggcgcgaaaatgttcctatcaccagaaaaggcgattgcgatcgaaaacgcgttagggccggatattatgatgagtttggatgagtgtccgccgttttttgagagttatgattatgtcaaaaaaagtgttgcgcgaaccagtcgctgggctgagcgggggttaaaagcgcataaaaatccggattggcaagcgctgtttggtattgttcaaggagccggcttcaaagatcttcgtgaacaaagtgccaaagacttggtaagcatggattttccgggatattcaattggcggcctgtcagttggtgagtccaaagatgaaatgaaccatgttttggacttcaccacacctttgctgccagaggataaaccgcggtatttaatgggtgttggttctgctgatgcgctgattgacggggcattgcgcgggattgatatgtttgattgcgtcttgccaacccgaatcgcacgaaatgggacgtgtatgaccagtcgcgggcgtcttgtcatcaagaatgccaagtatgcccacgactttggcccgcttgatcctaattgcgattgctatgcttgccgcaattacagtcgcgcctacattcgtcacttgatccatgttggcgaggcattcggtattcggctaacaacctaccacaatctttatttccttttacacctcatgcagcaagtacgtgaagccattgccaacgatgatctgcttgccttccgcgaagattttttcgaagcttatggttataacaaggaaaaggcgaagaatttctagattgtttggagcatggtccgaaattctgttacactgttgaatgacaaactaaaaaaacaagaggtgcctaaattgggaaatggtaatgtttcaatgatcgttctgctggtgatctttgtagcgttcatgtactttggcatgattcgcccacaaaaaaagcagcaacaaaagcgtcaggaaatgctaagtcagttaaaaaaaggtgatccgatcgttacaattggcggcctgcatggtgtgattgattcaattgatcagcaagcagggaccgttgtgattgactcagacggtatttatctgacattcaatctaaatgcggttcgcggcgttgcttcacgtccggcaaccccaaccccggctccagcagcaaaagccgaagcctccaacacagatgaacagcgtgtggctaaggaagcatctgatactgcggccaagtccgatgatcaaccggctgctgctgacagcgatgccaaagcagacgatgacaagcaggcttaaggttaaaggttaatgatgttaacagagagaccggttcttgactggtcttttttttacggccataagttcaaaaaaatacaaagtgaaaaacgttgaattcccctgacaaatcagcattgacagtgaacaagcaaaattttcgtgaaaaagttcactaaaattgtttacaaaatcacaatagcaaggtatgatgttcttgtgaaatggttaacaaaaattctgcgaattgcttggaggtaagctcatgcttaagaatactgcgaaggctgctactgaagttgatgtgaaaggcatgattgatgaactggttgccaatgcgcactcggctttgaagatcatgaagacttttgatcaagaaaaaattgatcatattgttcatcggatggcaattgccgggttagatcatcatatggaattagcgaaactcgctgttgacgaaaccggccgtggtgtttgggaagataaagccattaaaaatatgtttgccactgaagaaatctggcattcgattaagaacaacaagaccgttggcgttatcaatgaagataaacaacgcggcttggtatccatcgccgaaccaatcggggttattgccggggtaacgccggtgaccaacccgacatcaaccacgatctttaaatccgaaatttccatcaagacccgtaatccgattatctttgctttccacccgggtgcacaaaagtcttcagcgcgtgcgttggaggtcattcgggaggaagctgaaaaggccggattgccaaaaggggccttgcagtatattccggttccaagcatggaagcaactaagacactgatggatcatcccggcattgccacgatcttggcaaccggtggccctggcatggttaagtcagcttattcatccggcaaaccggccttgggtgttggcgcagggaatgcaccggcatacatcgaagcaagtgccaatattaagcaagccgttaatgatttggtcttgtccaagagttttgataacggtatgatctgtgcttccgaacaaggggccatcgttgattccagcatttacgatgccgtgaagaaagaatttgaagcccaaggtgcctattttgtcaaacctaaggacatgaagaagttcgagagcacggttattaaccttgagaagcaaagtgttaatcctcgaattgttggccaaagtcctaagcaaattgctgaatgggcagggattcgaattcctgatgacacgaccatcctgattgccgaactaaaagacgttggcaagaaatatccgctttctcgggaaaaactgagcccggttttggcgatggttaaagccgatggtcatgaagatgccttcaagaaatgtgaaaccatgttggatatcggcggcttgggacacaccgcggtgattcacacagctgacgacgaattggcattgaaatttgctgataccatgcaggcttgccgaatcctgatcaatacaccttcttctgttggcggtatcggggatctctacaacgaaatgattcctagtttgacgctgggctgcggctcctatggcggcaactcgatttcgcacaatgtggggacggttgacttgttgaatatcaagaccatggcaaaacggcgcaacaacatgcaatggatgaaattgccgccaaagatttatttcgaaaaaaactcggttcgctatctggaacacatggaaggcatcaagcgcgccttcatcgttgctgatcgttcaatggaaaagctgggtttcgtcaagatcattgaagacgttttggctcggcgcgagaatccggtacaggttcagacgttcgtggatgttgaacctgatccatcaactgatacggtcttcaagggaaccgatatcatgcggtcgtttggtccggataccgtgatcgcgattggcggtggttctgtaatggatgcagccaagggtatgtgcttgttcaacgatgctggcgatgcggacttcttcggtgccaaacagaaattcctggatattcggaaacggacctacactttcccgaagctgaataagaccaaactggtttgcattccgacgacttccgggaccggttctgaagtgacaccatttgcggttatcaccgattccaaagcagggatcaaatatccgttagctgattatgctttgacgccagatattgcgattgtggatagtcagtttattgaatcagtaccgccagtagttgtggctgattccgggatcgatgttttgtgccatgcaaccgaaagttatgtatcaaccatggcaacccactatacgaagggcctgagccttgaggcaatcaagctagtgtttgaaaacctcgaaaagagttatcatggcgacattgcggctaagtcaaagatgcatgatgcttctaccattgcagggatggcgtttgccaatgccttgctgggaattaaccacagtattgcccataaattaggtcaggcgttccacttgcctcatggtcgctgcatcgccatcaccatgccacatgttatccggttcaatgctagtcaaccaaagaaacgtgcaatctgggccaagtacagttacttccgtgctaacgaagactatgcagaaattgcccgctatcttgggctgccaggaaagaccaccgatgaattagtggaaagctatgttcaagccttcattaaattggcacatagcgtcgggatcaagttaagtctgaaggatcagggagttcagaaagcagatctggacaagcaagttgatcgccttgctgaacttgcttatgaagataactgcacggttaccaacccgcaggaaccattgatcagcgatttgaagcacattattctcgatgaatatgaaggaacggattcaacattctaagtacgcacatgctaatcatttcacgatgatcggcaattgttcatcagataaaccgtttgcgtcggtcgtcattaaacacgtcaagaaattgacgtgtttttttgtgcaagtcatggcataatgtagtacagtgactgcaaattaaaagtaaggatgtaaaatgacaccgaataaagaggattatcttaagttgatttttgagatcggcggcgataccgaactggtctctaataagcaaattgttgcggggatgcatgtctctgctgcctcggtcagtgagatgatcaataaactgggcgaagagaagctagtagcacacacgccttatcaaggcatccagttgacatcggctgggcgaaaaaaggcggctatcttagtgcgcaatcatcgtctctgggaagtctttttagttaagtgcttgaagtatcctgccgatgcagttcatcaggaagctgagaaattggaacacgccttgacgccagaaatggcaaaacgtttggcggccatgttaggcaatcctcaatattgccctcatggcggtgtgatccctgatgctgacggccactatattcagcagagtcgcgtcactttgggagcgatggaagtcggccaaaagggtcatattgaacggttgatcgatgaggtttcattgattgattacactgtcaaacttgatttacgccttgatgacgtctttacggtaaccgccaaaacgttggatgcagtcgtcatcaaactagatcgaactggaaaagaattggcagtcgatgctgatcgcgctgctcacatatttgttgaattgtaatcaagacttgggaaagcagggtcatatacatgccagaagaatcgcgcgctgtgatcattattttcggtgggtcaggagatttagcttcacgaaagctttatcctgcattgttcaatctttatcgccgcggagtgcttgctgaacactttgcagttatcggaactgcccgccgaccatggagcgacgaacattatcacgaagtcgtagcaaatgctgttgcaggtgcacacgcggatgctgaacaggtgcacgcctttgcccagcactttttctatcaaagtcatgatgtaaccgatgcagatcattacatcaccttgaaaaatcttgcggcaaagctggatgatcagtttgcagtcggcggtaatcgcgtcttttatatggctatggcaccggactttttcgaaaccattgccagtcatcttaagtcagaacatctgttgacggatgctggattcaatcgtttgattattgaaaaaccgtttggacatgattatgctagcgccaaagcattgaacgattcattgaccgcaacgtttgacgatgatcagatttttcgaattgaccattatcttggcaaggaaatgatccagaacctactggcgtttcggtttgataatgccatttttgagggcgtctggaacaaagactttatcgacaacattcagatcacgttatctgaagctgtcggagtagaggaacgtgccggctattatgaaaaggcgggtgcgttgcgcgacatggttcaaaatcacgtgatgcaagtattgtcttacctgactatgcccaagcctaagtcgtttacggcaaccgatattttaacggaaaaagataaggtgtttgctgcgttaaggccttatgatctggcagcagcaaaggctaactttgtgcaggcacaatatgtggcggcgcaaatagatggcaaaacggttccgggttatcgccaagaggaaggggtcgcaccggattcgcaaacgccaacttttgtcgcaggcaagattttgttggatatgccacaatggcaaggcgtaccgatttatattcgaacaggcaagcggctgacgcgtaaatcgacccaaatcacattaacgttcaaaccggtgaccgcgccgttatttagtcaagcagaagcaagccgcccggatagcctgacgatttacattgaaccgagcgaaggctattccctgcagcttaacggtaaagcattgggaacgggttttgacgttgaaccggatgagttgcgctatcgccacgacccgacagcggctgcagcagctccggaggcctatgaacgtttaatcagcaatgtgctggaaggcgatcagacaaacttcacgcattggtctgaattatccgcttcatggcgatttattgatgccattcaagcggcatggtcccaggaaacaacaatgccaacttatccggcggcaacaatgggaccaaaggcggcatttgatttacttgaacgcgatggccgcgaatggttctggcaaccacggcgcgttcagctagccgattgatgatgatactgaacaaagggacggagaccaataaaaggtcaaagcctcttttttaagtgagcgcgagccagcgcggttaggagccggagtgtaaggaccttgggcgtgatggccgggctttggccattgcgaccaaggtccttacacgcaggctcctgcgctggcgagcgcgttatggagcggaaaagccgacttctgcgcaggaaagcgtgttatggagcgcaagtccgacttcaagagttgttgaaacgtgtcaaggtcccggggaggtgagcaaacacatggcgttattcgaattacccttacaaaacgatacgtcacgtaaaattattcatctagacatggatgcgttctacgcttcgattgaaatgcgggataatccgcgactacgccataaagcattggtgattgctcgggatccgcggacgaccgggggcaaaggcgtggtcaccaccgcaaattatgttgccagacgttacggtgtccactccgcaatgccagccaatgaggcactacagttagtaccacgtaaggagctcgtttttaaaactccggactttcccaagtacaaagcggtgtcggcacagattcacactttatttcatcaggtgaccgatttaatcgagccggttgcgtttgatgaagcttatcttgatgtttcggctaaccatgcttttcccagtacgattgcgctcgcattgtggctacaggatcagattaaacaagccacccagctaacgagttcaattggcatttcatataataaatttattgctaaacaggcgtctgattataataagccggtggggcggaccctagtgttacccgaacaggcattgctgtttttggatcgtttgcctatcaagcagtttcggggcgtcggcaagaagacactaccaaaactgactgatcttggcgtcacaaacggcaaaacgttacgagcattgtcgcaggatcagttattaaccatgtttggaaaaatggggtttattttatatcaacatgcgcgtggtgttgataatcgaccagttgccgtacacaccgctaaatcgattggtaaggaacgaacatatggcacgccattaacggatgccacggcagttgagacccaattgcggaagctggcggcgatggtggtaactgctttgaatcagaagggaatgcatggcaaaacgttggtattgaaagtcagagacgttgactttgtgacccagacgaaacgattgactcaggaccattattttgagggtgaacaagccatttatacggcagcgtggcaactttggcaggaagttaaactgaccaagctagccattcgacttttagggattacggtcaccggacttgaccctaagcagtatgaaaatattgatttgccgttgtagtaaagcatgtgatatctaaaagtggtttctaaccgggctggctcacgctctgctgaaacgcgttcgccggcgcaggagtctgcgtgtaaggacctcgaacgcaatggccaaagcccggccatcacgcccgaggccacttacactccgactcctaagcacgccggttcacgctctgtattagtacactctcaccctatggtatactaacgatagattgcaatgaggtgatggtatggcgacaaagcatgagcagattttggattatattgcaaatttggcggttggtaagaaaatatcggtgcgttcaattgccaagcatttgaaggtgagtgaaggtactgcttatcgtgcgattaaggaagcggaaaatactggttttgtttcgacgattgcacgggttggtaccattcgaattgagcaaaaaccattaaatccaattgaatccgtgacgtttaaaaccttggttgatttgattgacgctaaagttttaggcgggcaggctggtatggacaaaaaactcgacaagtttgtgatcggggccatgacaccggctgctatgcgtccatacatcacgcgtaattcgttattaatcgttggtaaccgtgaagacgctcagcgattagcacttgaagacggagcagcggttctgattaccgggggctttgaaacaagttccgcgattattgcgcttgctgatgatcagcaattgccggttttacagacggcttatgatacatttacagttgcaaccatgattaaccgtgcgttgtctgatcaggcgattaagcaagacatcttaaccgttgccgctatttatacgcccctttcacaaatcgaaacgattggcgtggaggcaaccgttggcgattatctggcaatgacagatccccattatccgcttccggttgtaacgcgaaacggacgcttggtcggcttaatgcgtccggcactggcagctggcaagaaaccgactgtgccaatcgaacggctaatgcaaaaagatccgcaaactgtcaaaccatatttaagcgtgacgactgtgggccacacaatgcaggataatggcatgaacgcaatgccggttgttgatgacagttggaatcttttaggcatcgtcacgcgcaatgctgtcttttccagcttaaccgggattgcccatagtcgtgaactgaccaatacgattgctgaccaggtgagtgcacagttaacggctattaccccgcaaaagccatatggtggtgggtttgagctcaaaacagtgccggcgatgaccaatacgctggggacgatgagttttggcgtccttgctgaagccattaatagttgcacgactcgctacttgcatgataccgggcgccggaatgttttggttgagggcgttaacctgaccacttttcgaccggttcagttggagagtattgtgactgttttattgcgggtgcttgagctaacgagacacgatgcaactttggatgtggacgttctcagtgatggcgttcaggttgctaaggcagttgtgacttgtcagctattagaaaggaattgatcaaaaatgatccagaccgatattattaacgctattaaagccaataatccaattattattcatcgccacatcaatcctgatcctgatgcgctagggtcacaggtggggctggcagaaaccattcgtgccagttttccggataaacaggtttatcaagtcggcagcgatactggcaatttaagttggttggctgaagagcaaacaattaaggatgatgtttatcaaaatgcgttggtgattgtcaccgatactgctgatacgccgcgcatttcggatagtcggtttaatcaaggtaaaatgctcattaaaatcgaccatcaccccaacgatgatgcttacggcgatctcgtctgggtcgacaatcaggcgagttcagcttctgaattgatttatgatctcattgctgccagtgacggagctttaacgttgtccgacaaagcagcgcggttgctttatgccggaattgttggcgataccggcagatttttattcaacaatactaccccgcatacactgcaggttgctgctgaattaattaaaaaagacttcgatccgactgccattaacaatcggatgaataccgtgacgctggggcaggcgcgtttacagggctatgtcattgatcatttgaaaatcagtccggctggtgcggctagtgtgacggtaccgcgcacggcaattaatgacctgcatttagccgatgatcaggtaagcgcggttgtcggaactcccggtcggttagatacggtggttgcgtgggctgagttcattgaacaggcagaaggcggttatcgggttcacttacggtctaagggtccgattattaacggcctagccaaggaacataatggtggcggccatccactggcaagcggagccaaagcggccaattttgacgaaatcattcaaatcgaaacgcaacttgatcaattagttaaagacttttcaacaacaagaaagtaggcattatggacaatcaattcaaacaataccaactcaagccttttgtgattgccggccttgacgccatggggattacccagccgacgccgattcaaaaaaaggtgatcccggcgttgctgcgtggcgagaacctggtaggtcaaagccagactggtagtggtaaaacccatgcctttttggttccattgcttagcctggtagatccaaatgaagacgcgacccaagttgtgattacggcgccatcgcgggaacttgccaatcagatttacgcagttgcccaacagttgacgcaaaccgaaccggccattcgaattagtcgtttagtgggcgggatggacaagcaaaagcagattgacaaattgcaggcccatcaaccgcacgttgcgattggcacgcctggccgaattctggatatgatcaagcgctatgatcttgttccggcatcggttcgtcattttgtcgtggatgaagccgatatgactttagacatgggctttttggaaaccgtcgatgccattgcttcaagttttcccgaacatttgcagatggccgttttttccgcgacgattccgcaaaagctcgaaccgtttttgcgcaaatatatggatcatccgaccgtgattgaactcaagccgcaatcggtaattgccgataccgttgagaatattttaatcgcagttaaggggcgcgacaaaaacgagctgatttatcagttagtgacgatgggccatccgtttttggtgttgatttttgctaatacgaaaaccagtgtggatgccattcatgattatttgaaacatcagggactcaaggttgccaagattcatggcgggatccagcctcgagaacggcggcgaattatgaaggaagtcgctgaccttaagtatcagtatgtggttgccactgatttggcggcgcgggggattgatatcaaaggggtatcgatggtgattaatgccgagattccgcgcgatcaggagttcttcattcaccgggtcggacgtactggccgcaatggtttgccagggacagcgattacgttatatgagcccggccaggaagatcagattgctgaattggaacatatgggcatcaaatttaagcctaagaccattcaaaaaggtgagctggttgacacgtacgatcgtaatcgccgggttcagcgcaagcctaagcaagaggacacgagccttgccattcgcggcttggtgaaaaaagcgaaacaaaagcacatgccgaactatcgtaagaagatccggacagcagtgttattggaacgcaagcgcaatgccaaagttgcacggcgtcaagccttgctagccgagaaacgcaagcaccgtaaacgagggtgagaacatggccgtaaacgagttgacgttaccgacatggaatagcttggatgaaaaaagacaacgatttattttccaacagttgacccgctactttttgagtccgttactgacagttgatgagattcgaccggtgactgctactttttatgggcagacgttgcatacttttgaagccatgatcggcggcgaatgggtgcggttgattccggggatggcccaagtgagcttggggtttcatgcgcagcagcaagaacaactggcttcctacttgcaacaaagcggtttgaccgtaacggacttaacgcaggccttgtcgccgcaacgggaagtcgctatgccgcctatgctggttgcgactaaagccacgccagcaaacgaggagatcttagggcgcattagtttgacaactcgcattttcaagggtaatcacatgcgctatgctgcgattcgcgcgcaagtgttgcacctgttggatcggcaaggcagccttgatccttttgcccaaagcggttgggcggcgagcttgaccagtggcaacattaaattacgacttgccagcgctcatcattatcaagtgagcatcgtcaagtcctggcaaaaagcggatttgatcaagtcgctgagtttttttggctttcgattgccgactcaggatcagtatgaatatctgcaaagcggcggccggcaaagtctgtttgcgtttggcaataccttgccgccgcagttaccgcgttatttgccgaatccattcggtttgacgattccggttgaacgtgcgggtagtgaactgattgcggaagatattcaaaaaagtacagcgttgcccgcacagccatcagctaaagcagcgttagcattgtcgcctttttatcaggcagaaggtgccgatgacctgaccgttgccagttatcggcgggttgcaacagttacggttaattgagaagccagacgtcgggtgtcttgaaccatgacgaatagtcggttgtttttcaataacgagttgacccggttttttagaaaagctataattgggactcgttaggatatgtgtcgacccctgagtgagacagaaacagccgcatacgttgagagcggctgcaccgggctaagatatgctccctaatatcaggtgaacgaatattaatgaagtggtaatgactcgcatcattgcaaccaaggtggtaccgcgtgcaagcgcccttggcagcaatggtgctttttatgttgataagggtgtgcggcccacgttaacgcgtttgttggcgcagggatctgcgtgtaaggaccttagtcgcgatggccaagcccaggccatcccgcccgaggccgcttacactccgacttctaaccgcgccggctcgcgctcactttccataacgcgctccccagcgcagggatctgcgtataaggaccttggtcgcaatggccaaaacccggccatcacgcccaaggccacttatactccgatccctacccgcgctggctcgcgctcaccataacgcgctccccggcgcagaagtctgcgtgtaaggacctcagccgcaatggccaaagcccggccatcacgtctgaggccacttacactccgacttctacccgcgccggctcgcgctcactttcttttaggaggaaatttcatgaaaaaaatgtcaagtggcgagattcgccaaatgtttttggattttttcaagagtaaaggtcatgcagttgaacctagtgcttcgttgattccggttgatgatcccactttgttgtggattaactcaggcgttgcaactttaaagaagtattttgacgggtcggttattccagacaacccgcgtattaccaatgctcaaaagtcgattcggaccaatgatattgaaaatgtcgggaagacggctcgccatctgacattttttgaaatgctgggcaatttctcggttggcgattatttcaaaaaagaagtcattccgtgggcgtgggagttattgacgagccctaagtggtttgattttgatcctaagcgtttgtatgtcacagtttatcctaaagataaagttaccaaagaactttggcgcaaagttggggttgcggacgatcatatcgttgaggctgaggataatttctgggatatcggtgaaggtccatctggtccggattccgaaatcttttatgatcgtggccagtcctttaacaatgtggctgaggatgatccggaaaactatcctggtggcgagaattcacgttatgttgaaatttggaacatcgtcttttccgaactgaatcacttaccggatggccggtttgttgagcagccgcataagaacattgatactggcatggggcttgaacgtttagtcgcggttatccaaggcacgccaactatttttgaaactgatttattcatgccaattatcaaggcaaccgaaaaaatgagtgcaggcaagcgttacggggccaatgcgcaagatgatgtgtcctttaagattattgccgatcatgcgcggacggtaacctttgcgattggtgacggtgcactgccaagcaatgaaggccgcggctatgttttacggcggttgattcggcgggcggttttaaacggcaagaagctcggcatcaatcatgactttttgtatcaactcgtgccggttgtcggcgagattatgaagagctattatccacagattctggccaaccagccgtttattcaaaaagtcattgaatccgaagaagcccgcttccggcaaacgcttgacgccggggttaatctgttgaatcaaattattgctgaactgaagcaagacgggaaaaaagaaatttccggtgcggatgcatttaaattgtttgatacgtatggcttcccggttgaaatgacgaatgaatatgctgaagatgaaggcttgaaagtcgacatggccggcttcaaaaagaacatggctgcacagcgcgatcgggctcgcaaagcacggggtgatcggcagtcgatgggcagtcaagataccgttttgatggacattaccacgccaagtaagttcaccggatggaccgagttggatcataaacatgccacgttacaggcgattgttgtggatgatcagcttcaggatgaagtcagcaccgggcaagcccaactgatttttgacgaaacgcctttttatgccgaaatgggtggtcaggtcgctgatcacggggttattaaagctcaggatggcaccgtattggccgaagtgacggatgttcagcatgcacccaatggtcaaaacctgcataccgttaccgttaaaagcaaattgacgaagggacagccatattggctcagcgttgatcgtttgcggcgtcagaaagtttcacttaaccatacggccactcatttgctggatcaggcgttgcgggatgttttaggtgagcatacccatcaagccggttcgttagtcgagcctgattatttgcggtttgacttcactaatttcggtcaggtaacgccaaaacaactgcgcgaagttgaaacgattgttaatcagaagatctgggatgctttgccgattacgtggaaagagatgccaattgctgaagccaagaaacttggtgcgattgcgatgtttggggataaatacggtgatgtcgtgcggattgtttccatcggcgattataacaaggaatttgacggcggcacccacccaaccaataccaatgcgctaggtctgttcaagatcaccagcgaatccggcattggcgcaggggttcgccgggttgaagcagtcacgtccaaggaagcttatgaatatctgacccaacagcaggactggcttaaggaaacggctgatcatttgaaaatagatcaagtgaagaatgtgccaagcaaggtcacccaactccaagctgatctgaaaaccgaacagaaaacggtggcaggattgcaagctaagttggcagcccaagcagcagccggcatttttgaccgcgctgaaacagtaggcggatttaagctgattgccaagcaggttcaggtagccggaatgaatgaattacgacaacttgccgatgagtggaaaacaaagcaggcttcggacatattagtgttaggtaccgaagcaaatggcaaggcaaacttgttagtagcggccaatgccaatgctaatcaagccggtttgaaagcaggtgacctgatcaaggccattgcgccaaaagtaggcggcggtggcggtggtcgtccggatatggcccaagcaggcggtaagaagccagctggcattccgtcagcactggcagaagctaaaaacgtgattagccagcatgcataagcattgaatgcagtttttcttaaatcaaacaatggacatcaggagttaggatggcgttttgctgactgacttctggtgtttttgtttttgctgccatgaatacgggaagtcatggtagaattaagaaaacgatttcagcgaggtgagggagatgaaagcgttgcggttgggaatgacggattttttggggtcgcgtgaactgtatcgcgttgtccgtcaagccgatagcgttaaactgacatatacggttgatccatcaagtaccgaggggacaatcgaaaatgaattgactggcacagatgcggaggcgtttttcagccggttagcaacgtttgactttgcgtcttggcgagtacttggtgaaccgcagccgccactgcttgctgatacacggtggaaccttgcgataacggaagatgatgaacgggttttgcgatatgaaggcggacagccatttccggataggtttaatgagctactgagtttattaaaatataccgtgacggttccgggcggccattttttaccgccgatcgcatggcaactggattatgtgcgatttggtacgttacagttaccaaagtttgaaggcccaagacgattcttaagccggcagttacgctatcggcggacgtatttgattgaagccaacgagaaccgggttgtgttgcgcacccagtatgctgaaccgcttagtgatcatgatgtggtctatcatgatcccaaattagtcgcggcactcgcttcaaaagtggcagctgcagttgctgaattgggtgaagtcgctgacctgtcaattgattcaacgtggcaaccacggtctgtactggctttgacgattcaatatccccacggtgagccaacgcgtattcaggtggatgccgagttgaatcggaccatgaaaatgctatggcagaccgtcacagaagcaattcaggcatttcagcgcagcagtgaacaccgagatcagcaagatgccattcagcttgggccgcaattgatgcactatatcaaggtgaatttccgccacggggtcaaagactatctgtacaaaacggatatccccagtttgcaggaaggcgatctagttctcgttccggtgggcaatgaaggtcgcacgttacatgctgaagttacgaatccgtatgtgatgccgccaattcactttccggtaccccctgataaaatcaaacaggtgatcggattggctgacttggatgatgatgaagacgaagacgattggtgttaaagcgcatcgtccaaaaacatcacttacttttgctcaggaattgtacatttgcattgatttcaagtaaaatggtctgtgaagcggatagaatagaggtgtaagaatgagcacattagatcaaaccgttcactttgattttcgcgataacaatcctaaaaatgttcacgagacgttggaaactgtttataaagcactagaggaaaaaggatataatccgattaatcagatcgtggggtatctgatttccggggatccagcgtatattccgcgttataacgacgcgcgtaacctgatccggaaacatgagcgagacgagatcattgaagagcttgttcgaaactatcttggcaaggagcaagcttaatgcgcttgatggggttggacgtcggttcccgaactgtgggggttgcggtcagtgatcctttggggtggactgctcaaggattagagatcatccgaatcaatgaggataagcagcagtttggactcaaacggctcaaagaattggtgacccaatatgaggtgacggcatttgtcttgggattacccaagaatatgaacaattcaattggaccgcgcgcagagaaatcacaagcatatggtgatttacttaaagagacgtttgggctgccagttgatttcatcgatgagcgattgacaacggttgaagcttcgcgaatgttaattgaagaagcagatgccagccgtaagcggcaaaaacaagtgatcgacaaactggcagcgcaaatgattttgcagaattatctggatgcaaaaggtcccttgaccaggcaataactctggctgcggccgtgcgcccctgccagaattgaaggagaacaagatggcaaataatgaacatgtcaaacccggtgacgacaatcagcagattaccctgattgacgaaaagggtaatgaagagttatatcaggttttgtttacatttgattctgaagattatggtaagagctacgtactgttgtatcctgccagtgaagatgatgatcaggaagtcgaaattcaggctttctcgttcacacctgatgcaaacggtgatgccagttcgggggatcttttcccaatcgaagatgataaggaatgggacatggtcgaagaagtgttgaatacttttttggctgatgacgattcgaatctacaagattaatgacgtcatgaacccatcaggccaccagtattttggtggcctttttgtggcaatgccaaaatgccccagtatgggtggtccaaagaaggaacgaatagagtagaaacgaaggaaagttggcgcataccgaagcacttctgctcgcactttaccagttatggtagaatacactttgaaagagtggaggcattcacgccatgagtgaagagaagcgtcgttttaaggccgttatcggtgataaagcgtatacgattatcggtcccggatccgaacagcactttttgacggtcacgaagctgttgaatgaacggcttgatcaagtcaaaaaacttgcgccggatctgactgccgaggaacaggcgattttagttgccttcaatgctgtttctgatcaagttaaattgctggcagcccagcaggatcattctgatcagaaagcataatgggggaacgttttgatttcaattacgattattttagttttggcctatttctattatagcggggctcgccgtggtgcagccttacagtggttgcatgtgggtggttatgccttgagttttttagccgcaacggcactagcccgacctttgggagaacactttacgttgttgatcccttacccctctgcgacgaatgcaggacagtttgccttttattccgataaaatcggcttgacgctggatgatgcattttatcgcggatttgcttttttagtggtgctcacgatcggctggttgttgacgcggattgcggccttgtggttccacgacttgacgtataaagcaatggcgcacaaaaagagtgcattaataggcggctgggccaatttagcgatagggtatatttttttatttctcattttgtcattattggcattgattcccatcaccggcattcaacatgggcttgatcactcgcttgttgccaaaatgatgattaaatactcacctgggctgacacagtttgtgaatgccctttggttatgaacatgatgacgctcaaggacggataactgacgtctttgggcgcttcttgattatgggagcaatttaaatgaacacgaagattttaagaacacttgagtacgacaaaattcaacaggccttactgcgccaagtggtaacggcaaatggacagaaaatggtccaaaacatgaccccgcaaacagatcccgaaaaggttcagcgagcattagacgaaaccgcagatggagcttcggcattgcgacttaagggcggcattccggttccacagttggaaaatattgacccagcgctaaaacgggttgatattggcgccgtgctaaatggtcaggagttggccagtatcagtcgggttctgcaaacagtcagtgcaattgataaattcttaacggatttgcaagaccagattgactttcgccagttgtattcactgcaggccgagctgaccgtgctgccacaactatcaaggcggttaaagacagctgtggatcctgaagggacgctaacggatgaagctagtccggagctgcatggtattcgcgaacagattaagcgaatcgaaggagatattcgcggcaaaatgtccgaatatactcgcggagcgcagtccaaatatttaagcgatccgattgtgaccattcgtgatgatcgctacgttattccggtaaaagcagcttatcgtgccaagtttggcggggtcgttcacgatcagagtgccaccggacagacgctttttgttgagcctcaggcaatcgttgcgctgaataatcgcctacgtgaggcacaaatggccgaaacagccgaaattaatcgcgttttggctgaactgtcgaatgaattggcgccgtataccggccaaattaaggctaatgcggcggttttgggacattttgattttattaacgccaaagccaagctggcaaaagcccaaaaggcaaccgagccactcgtatcagctgaaaatgatgtcctgctgcgccatgcccgccatccgctcatcgatccccatcaggtggttggcaatgacatcccgcttggcgctgattatcaagccatggtgattaccggccccaacaccggcgggaagacgatcacgttaaaaacgctgggattgctgcagttaatggggcaatcgggcctattcatcccggctgacgatgagagtcggatcgggatctttgatgaagtttttgctgatattggcgatgagcagtcgattgaacagaacttatcgacgttttctgcccacatggataacattgtccatattcttaagcagctttcgcaaaacagtctcgtcttgtttgacgaactaggcgccggcacggatccgcaagaaggggcagcgttggcgattgcgattttggacgcggtgggtgaagtcggcgcgtatgtggtggcaacgactcattatccggaattaaagctctatggttacaacactccgaagaccatcaatgcctcaatggagtttgacagtcaaacccttcaaccgacttatcgcctgttggtaggcgttccggggcgctcgaacgcctttgacatttcgttacggttggggttgccccacacaattgttgaccgtgccaagtcgatgatcggatccgatagtcatgaacttaacgacatgattagcgatttggaaaaacagcgtaaggccgccgaaactgctcgcgcttctgcacagcggcaattagcagcagctcaggcacttcatgatgaattggcgagcgcatatcacacgtttaccaccgagcgcgatgctcagctacaccaggccaaagaaaaggcgaatgcgctagttgacaaagcacagaaaaaagcggataaaattattaagcagctgcggcaaatgcaactgaccaatccgggtaccgtcaaagaaaatcagttaatcgcagccaaaaccgatctaaaacggttgcatcaagatgaaccgctgcagaagaaccgcgtgttgcggcgagaacgcgaaaagcaggcgttgcatgttggtgatgaggttaaagttgccagctatgatcaaaccgggaccttgttacaacaatttgatgagcatcattggcaggtacagttgggaattttgaaaatgaaagtcccgacaaccgagcttgaaaagatcaaaccatctaagcaggcagccaagcagcggccggtcgtcaaagtcagtggcggtggcatgagcggcccttcaacaaccttggatctacgcggcgaacgctacgatcaggccatggctgacttagaccagtatattgacgcagcactgttagccgggtacccatccgtcacaattattcacggtttaggcaccggtgcgatccgcaatggggttacccaatatctgaaacgtcatcgccaagtcaaaagctttggatttgccccgcaaaatgctggcggctccggagcgacgattgttaatttcaagtagttggctagttttttgccggtagatgtgctatgatttagttacaaaaagtaagaggaggaatccgttcatggttcaagcagttacagattcaaactacaagacggagaccgacactggcgtcaccctcactgatttttgggcgacttggtgcggcccttgtcggatgcagagtccagtgatcgacaaattagccgaaagtcgcgatgacgtcaagtttgttaagatggatgtcgatgctaatccggagacacctaaatcattcgggattatggcgatcccaacgctggtcatcaaaaaagatggcaaggtcgttgaaaagctggtcggttatcaaaccaaggatcaattagaagcaaccttaaacaagtacaccgcttaattgaatttgtgatccagacacactgattgaatggtcagtgtgtttttttgaccattttttcggggacgccagaatcaagaaaacaaaaaaatatcccaaaattctgatttcatctaaaacgagggaaaacaatatcttttttagctttaagcggatatatttaagctatttcgatggcccgtcaccgaatttttcaggcaaaaagtaccggctgaatttgcgctgattcgagtctgaaaaaatgccgccgatgcctagtgtttcgggactttgaacggttatctaactggcctgtttgattcacattacgaaactgttaggtgattgttacgcttttcgttggcgaggctttttctgtaaaactataatggatgtgtcaataagaacgtggggtgacaagatgttcacaaaattaaaagcggtgtgggaaaatcccacatttcggttcatcttttggaccgtcacgtatttcgtgatactgctggtcctggtttatctatatggttacagcggtattaacaacagtaaattcatttataacgagttttaaagggggaaaccgcgatgatcgataatgttattacagcgattgatcgggtcgccgcagagcatccaacgcgcgtggcttatgattatgaaggtacccaatatacctacgcgcagttgaaagaaggcagtgaccgcctagctggattctttgcggaatcattgccggctggtgaacccatcatcgtctatggtggtcaaacctttgacatggttgaggttttccttggactttctaaatcagggcatgcctacattccgatcgacacgcatagtccaaatgaacggattacccaggtgcaagatgttgcccacgcgcctgctgtgattgaggtggcaccgcttccgattacggttccggatgtcaagattattcaggcgccggagttacatcaagctgagcagtcacacgcgccaattcattcactgcagcatgcggttgctggcgatgataattactacatcatctttacaagcggcacaacggggaaaccaaaaggcgttcagattagtcacgataaccttttgagctatgtgaattggaatatttccgactttgggcttgaagaaggcgttgtcgccatgtctcagccgccgtattcctttgacctaagcgtgatggatctttatccgaccttggttttaggtggcaccttgaaggctttaccaaaagaagtcaccgataactttaaagaattatttgcgacgttgccaaaattgggcttgaacgaatgggtatcaaccccttcttttgtcgaaattgcgttacttgatccgaatttcaagcaggaaaattatccgaacctgacccattttctgttttgcggtgaggagctagttaacaaaaccgcccaagcgctgatcacacgtttcccgaaagcaaccgtctataacacgtatggtccgaccgaagccaccgttgcggttacgggaatggcgattacccaggcgattgttgatcaatatccgcggttaccgattggctatgcaaagcctgataccaacgtttatgtggttgatgagcaaggtgaacaggtttccgctggcacggaaggcgaattgatgatcgtgggtccaagcgtgtcgaaagggtatctcaataatccggacaaaacagccgcggcatttttcaaggctggcaatcaacgcggttatcggtctggtgacttagtgaccatgaccgcagatgggatggtcttttatcgcggtcggaccgatttccaggttaagttgcatggttatcgcattgagctagaagatgttgatcacaatttgaatcaggtttcttatattaagcaggcgtcaacggttccgcggtatgacaaggatcataaagttgcccagttgattgcctttgcggttgccaaaccaaatgactttgatagcgaaatgaaactaacgcaggcaattaaagccgaactagggaaaatggtgatggaatatatgattccccaacggattatttaccgggatcagttaccattaacggctaatggcaaggttgatcgcaaagcactgattgcagaggtaaatcattaatgcttaatttacaaccgtatgagaatccacagtattttgtctatttaatcattgccttgcttcccgtcatcatcggcatgttcaaaggctttcggatgcattggtatgaaagcatcttttcgttggttttcctggtactgatttttgacgccgataaatggcctcaaggaaaagcattattgggctatgtggttttcaacttgttactggtttacgcgtatttcaaatatcgaacgcgcgaaggctcaaaaaattccacggcagtcttttatctgagtgtcgcgttgggaattgcgcagctggcagttgtcaagtttacgccgctgtttcaacatcatggttccattctgggctttctcggcattagttatttaactttccgagtggtcggcacgattatggaaattcgtgatggatcgattaaagacctgaacatgtggaagtttatccaatttctgctattcttcccaaccatctcaagtggcccgattgatcggtatcggcgatttgtcaaagattacgatcgcgttcctgatcccgagcattacgcccagttggtgaccaaagcgattcactatctgatgcttggttttctgtacaagtttattctggggtatatctttggaaccttgtggctgccttctgttgaacacatggcgatggccagtcgcggtggggctttcttgggactcagttggccagtcgtgggcgtcatgtatgcttactccggttatttgttctttgattttgccggttacagtttgttcgcggttgccatttcctacttgatgggcatcgaaacaccgatgaactttaataagccttggatgtcatataacatcaaagacttctggaatcgttggcatatgagtttgagcttttggttccgtgattatatctatatgcgctttgtgttctttatgatgaaacacaagtggattaaatcgcgggtctggacggcatttgtcggttacctcgttttattcctgattatggggatttggcatggtgagacctggtattacattgtctatgggctgttccatgcgatgctcattaatctgacggatgcatggctgcggttcaagaaaaagcataaggactttttcccgcataaccgcgcaacgcactacttcgccattttcatgaccgctaatgctgtatgcttctcgtttttgattttctccggtttcttagacaagctgtggttccactaaaagaatgttgttgtaggcggtcaatcgcttgaagattggctagggtttaaaagaaagaggtaattcatcatggcagacgaagcaattaaaaatggtgttttggatattttggcagatttaacaggttcggatgatgtgaaaaagaacttggatctgaacttatttgaaaccggactccttgattcaatgggaacggttcagttgctattggaactacagagtcagtttggcgttgacgcaccggtttcagaatttgatcgtaaagaatgggatacaccaaataaaatcattgcaaaggtcgaacaagcacaatgaaaaaaccgatcgggaagatcctttggcgcggacttggcccgttgctgatcgctatcatcctggtcgctgcgttgatgctcgtgccatttaagtttggccgcagcagccaagcaacgatcaggcaggcggccagctccatgtcggccaacgtgctgaaaggcgaaactataaaaaacgaggccatggccgaaaactatgtcccgttcattgggtcatccgaattgtcgcggatggacgcatttcacccttccgtgttggctcagaagtatcatcgtgattatcgcccatttctcatgggaatggcgggaacgcaatcactcacgcacttcttgtccatcaatgccttgacgcatgttgaaggcaagaaggcagtgatggtgctgtccccacaatggtttgtaccaggcggtgttcgcaaagcccagtttgattatttctattcgccggcacagatgacaaccttcttacttcatgctaacccgaattcggaagcggatcgctttgcagccagacggttacttcaatttccgtccaccgattctgatcggaccgtcaatgaagcactgaagaatattgctgccggtcagaaactgtcagatggccagtattggtatttgaagcaggtcaaggatccaatggctgatcatcaggatgcgttgttttcacggctatttttaaataataaccaaccgcaacttgataaggctgccaagacattgccaagtacttacgatgttgatgatctagatggattggcaacgcggatggggatgcaggagacgaccaataacccatttgaattgaagaatgatttctacacaaagcgggttaagcggaacatgccgaaattaaaggggtcgcaggcaacttggagttatgttaagtcgcctgagtattcagacttacaattggtgctgaatacgttcgccaagaagcatatggaagtgctctttgttatcccgccgatcaatgcaaaatgggcggccttcaccgggctggatctaggcatgattcaaaacacggtcaccaaaatgaagtatcagctgcaaacacaaggctttaatcacgttttggatttgagtcaggatggggcacagccttacttcatggaagataccattcatattggctggcgcggctggctgaagatggatcaaacggtgcggccatttttgaagacaaccaaagcagctcccgttcattacaagctcaatgatcagttttataccaaacactggcaacagcaatcggccaatgggttagattagaggccagtcagctttaggtgtcctagcattatgtagtaaaaagtgaaccaagcataaaaaacgaagggcaaacgaatttctcccatgtcgggaaaatccatttgcccttcgtttattttctgtatgcaagttgactcagctttgatcgcttgcaagatcaattaaatgtttggcggtgggttgcgcatctttattgtccatcacaacagtcagaacaacattttgctcgcggcgctgaatggcactgcctccttcgactgcaaagccaaatacctgctgcagcgcttgcgctaaaaagccggcttcgagttgaaagtcgggatcgtcataggtacgaatccgagtcgcgacaacatctcctgcaagcagatattggcgctcttgccgtttctgtttaagtggcgacaaagttcccagaccaacctgggtgaatagctgtggtaaggcagattccgcgacaggtaatttggttgccaagtcacgtccagcccaatagagaatatggtgctgttcttcaccaagcatatttggcagcataagatcgcgcattgccgtgattgcaaagaatgaaaccgagccgggaaggttcagcagggtggtataatcagattttgccatgttgtgcctcctgtttctattcgtctagtatagccgaaaaatggattgataacatacttttctgagtgcttgcattttttttggattaaactcacaataaagactcggagctttatagcggtggccagcacgataagggatcgacggctgcgttccttttcgagggacagggttgatgttggaaataccacgggatgggttggcgtgaaagaaggggccggcagcggcttttctggacacggcgaccactaatcggcggtcttgccgtcatcaagtgattcaaaaggagaattatgatgaacaagcaaccaatcggatttattgattcaggtgtcggcggcttaacggttgtgaaagaagcgctccatcagctaccagccgaaaacaccatttatttaggggatcaggcacgcttgccatatggaccgcggccagctgagcaggttcaggcatttacttggcagatggtcaactttttactcaccaagcatatcaaaatgctggtaattgcgtgcaatacggcaacggcggcagcattaccgttaatcaaggccagattgaagatcccggtcatcggggtgatcaagcctggtagccgagcagcgttaaaggctacccagaccggccatattggtattattgctacggaaggtaccgtcaaaagcggggcgtatcctaaagctttacgagccaaagcacccgacattcgcctcacgagtctggccgcgcccaagtttgtgtcgttggtggaaagtaacgaagcgcactcaccgattgccaagcgtgtggtagcggacaccttgcagccgcttttacatcaagatattgatacactggtgttaggttgtacgcattatccgattttgcggccgattattcagaatgtgatgggtgaagacgtcacgttaattgattctggtgctgaaaccgttaatgatgtttcgatgttgctcgactattttgacttagccaacgatggtagcgaggtgccaacgcatacgtattatacgaccggcgcaccatcaatgtttgacgaattgggggaatcatggttggaactaaaaaaaccgatgcacgcacagcatgttgacattgatacacaaccaacgcattttgtagagccgacttctgaggcgactgataaaaccattgtcattgccagcaagaaccccggcaagataaaagaatttaaagcgatgtttgagccagcaggggtaaccgttaaaagtttggctgattttcctactgtgcccacggtggatgaaaccgggaccacttttgaagcaaatgcccgccaaaaagctgatcagtatgcacaggatttaaatttgccggtgcttgccgatgactcagggttgatggttgatgccttggacggacaaccgggaatccgttcggcgcgctatgccggtgacggtcacaatgacgcggcaaataacgccaaactgctggctgctttggccgatgttcctgaagaagcgcgaacggcaacgtttcatacgacgctggtattagccaagcccaatcaccctgaagccgatttggtggttcatggcgatctatccggacgcatcacggcgatcccccgtggaacagacgggtttgggtacgatccttttttcctggtgccggcgttagataaaacgttagccgaactgactgcagatgaaaagaatgaaattagtcatcgtggtaatgcaatgcgcgcattggagaaggtttggcaggcatggttggaggaaaatgtatgaagattttggcagtgagtgacgcacatggcgaccgcgatattttggcggctattttgaagcaacagccgaatctagatggttatttttatgcgggagattcggaattacctgcaaacgatccgctttttaaaacttatcgtgcagtcgcaggtaatatggattttgatccggattttcccatgaccgtcacagcaactattgataacaccacgatttttatgacacacggacatcgtttcggggtgaactttggactggataagctggtggcagcgggggaagcagcccacgcacggcttgtgatttttggtcacacccatcagttgggtgttgaagaacatgccgggatgattgtgttgaatccaggctctattagccagccgcgagggcaattcgccaatctcggcggcacatatgccacggttacttttacatccgatcagattcacgttgatttcttgaagcgtgatggcagtatcgttgcaccgttaagccgtgattttttgcaatcatcacactgattacggaaacattgtggcagcgggataggcgagtatagaaaaacggtcccaattacggaaccgttttttatatggtcatctttaatttgaggttaaagaaataagagcttatacgttaaaacagctaggatagcagcggcgatgggtgctacaaccgggacccaagcgtaaccccaatcggagctgcctttgtgttttagtggcaacagtgcatgcaagatacgcggtcccagatcacgggccgggtttaatgccggtccggttgggccacccaaagatgccaccagcgttgccacgagaaatcctaaacccatgtgtgcagtgccaaggttgttctggaagaaaggtgccttagtaatacctagagcgccaatgaaaagaatgtaagaaccgataaattcattaacaaaaccattcagcttactcttggtggcactaatcgtactgaaagttccaagaatatgctgtgtattggtggtgagatcataatgcggtttatacgcggcaacgacaagcagctggcctaccattgctcctgccatctgaacggcaatatatggtagcacctcggaccaagggaacatgcctgatgctgctaatcctagggtaaaggcggggttgatgtggttaccggagatggcgccaaacatcatggcagggatcatcaccccggcaccatacccaacggcgatcaacagccaatcggagccatttcctttggtacctttcaaatcaacgttggcaacggaaccgttccctaacagaaccataacggcggtcccaataaattcagcggctaaccgcactcctaaatcatatgtcatttttttcctccaaattagtcaaagatcattaaagtttcagtagagcttatacaagtataattattgctcaagatagtgtatcaatttttataaataccgtccattgaaattcccttggagagcgcgttatagacagctcatggtaaaataatatgaggtgtttatccgtcttttggcggatggcacttaccttaatgagcgttaagatgctttaaagaaggttacttagctcaacataatttcgctttttcagctagaatagcaatatcaaaaaggagctagtcatatgttaaatcaggtcattgccaacatgctggttgaaaatcggcatcactttatgatcgctgcggatatggtggcaacggtttcggagaataatcccttgagtcacgcctttcttgtgcttacaaaggttagatatgcaaagattcccgtgttggatcatgattcgaagttcaaaggactcatctcactacctatgattaccgacacgatgctggggctggaccatatcagttttcaatctttggacaccatgacggttaaagacgtgatgcaaaaggatgtcgccacgattaacgacccatatgatttggagactgtgttacatttgctggtcgataatccgtttattccagtcgttcaggatggctactttacgggaattgtgacgcgacgtgaagtgatgaaaggcatcaataacattggccataacatcgacaaacagtttcaattggaaccggtcgcaccggtaacggagaaagaatcttaattgattaaaaccagcaaagcaaatgaatgcgtgctggtttttttgctgtcatcaggcatcccgatcgctttccggtttatccaaaaagacagttgccaaaaccccaatcgtgagactgacaagaacggccaatacagcagccagcatacctgtagttggccaataaggcgcaatccccgtttcaatcaggatcaccaccgccgcggcgacaatgccacaaaccgcgtaataaacctcaacctcaaaatgttctagtaaataacccattagtttggcaatggcaatgagcccgatcaacgcacctaccataaaaggtaccagtaaggcgacagatcccatcgcggacgtaaacccggcccaattaccggcaaccaaggcccgagcagcatcacctaactgactgacagcatggtaaaccgtgccatattgatcaatcaccatgagcatgaccgatccggaaatcccgggaatcgccattaatgatacggcaaagatacctgaaaaacccatgattgcggcatcccgcacgctcgatagtcgttgaatggcgatcaggttctccggttgggtgccgccaagcttggctaatccataaatcgcaataaatccaccaagcatcaacaaaagataccaccatgaaaacggcttaagaaccagcttgcgataaatgaacggtccgatccccagtaccaagccgatgaaaaaaccgtaactcggtaatggccagtgagtcgtgataaccagaaccgccttagtagacaaaaggatcccgacaattgcgcctaagccaaccggggtcagaaagcgtaaatttttgcgcggattggcgcgaaagtgattaagtgcatttaagaggcgatcataaagcccaaccacaaccgcaaagatactgccggaaagtccgggaatgacaagtgcaatgccgataatggcacctttgataaaattaagcatgacatctccttatagatggatttattaatagacaaacacggataaggtcgatcatgaacctgcttgcagattcagcggcggtgtaatgacatgaatgccggcagatttcaatgcggcaatgtaggcagccaggaaagttcgtttgaggctgacttgttcaccattttcggcgtagaacagaacctgataggtaaaagttccgtttttttcttcagtcaggccaaggatatccggcccatccgtaatagttgagaatttcggtaccagattgtgattgacatgttcaatcgtgcggcggaccaaatcaagatcggtcgttggggctaacggcaatttgataagtacctgcatgttgctgcgggaaaggttgctgacaatcgtaatgttgcgattaggaataaagttaaccgtaccatcgtagctttttaccacagttgtgcgtaatcctaggctagtgacggttccggaaatcgttcctagtttaaccacatcaccgacatcaaactgggcttctaacaaaatgaagaaaccagttacgacatcattgacgaagccctgagcgccaaagccgatcgccaacccggcaacaccagccccagcgagcaacgtgcccacaggaacgcctaatgttgagaggatcgcgtaaaaataaaagaagagaacaaagtagaaaaaaagatttttggacaacgcgtggatagttttgacgcgtgttcctgataacttggcgcgatgttggtaacttttaaaggtgcgattgatggcaaattggcctaagcggtagagcgcaagaaacagaattgagaagaatagcaacgagagcactttatcaatcaaagttccggcaatctggtcccaattaattttcgtaaagtaccttaaccagacattggattgtccagtcacggtcgcggttgtgaagatcatgcgaatcacgtgatggcctcctttgtattagcctcattttatcagaatcagggctagcttgctggggatttgccgcgtgtgaggcaatttttaatgttaggtagggttgtgaaggaagtgtgaggacggatggtttcaatatgtggttgtaagtgcagaaagctacgtctgaaatcggcttaggatctgaaacgcgtttacgggatcgaaaatctggaaatctgcatgtaaggaccttggatgtattgaccacaacccagtcaccacgctcaaggccacttatattctggtttacgcccataacgcgctccccggcgcagaagtctgcgtgtaaggaccttaagcgcaatggccaagtgcgggccatcacgcttaaggccacttacactccgacttctaaccgcgccggttcgcgctcacgctctgaaacgcgttcgccagcccagaaacctgcgtgtaaggaccttgagactaaatggccatagcccagccatttagtctcaaggccacttatattctggtttacgcccataacgcgctccccggcgcagaagtctgcgtgtaaggaccttaagcgcaatggccaaagcccggccatcacgcttaaggccacttacactccgacttctaaccgcgccggctcgcgctcacgctttttaaatcttttgcacgcgtgttgtgacgatgttatgattaatgtaaccaactggtttgaaataggagggtgttggatgtcaggtggagagattgcttggattattgcggcaacggcttttttgattattgctttggcgattgccatcattgctgttcgcgtttctggcgtaaccaaagaagttaaagaaaccgttgctgagacgaataagacgttggatacgatcaacggggagcttggcattttgacgaaagaagttgaaggcctacttgccaagagcaatacccttcttgaagatgtaaatggcaaggtggcggcgattgatccggtctttaccgcgattggtgaacttggcgaaagtgtttcggacttgaaccagtcaacgcgtcagctcactcagcgggtcacgaatggtgcaaaaaacggggctaaggcaacggttgctgcacgaatgggtgccaaagcattttcaatgttgaccaaaaagaaacatcaaaatgaatagcagggggaaacataatggctaaaaaaggacattttttgcttggatttgtatttggagctgctagcgccttggcaacgacttatttattgacaccgcaaaccagtgatgagttgaagcggcgggttaagcatgcgtctgagaaccttgctgatcgcgcggttgattatttcgattacgccaaagaagcaagtgctgattggaaacagagtgcaacggatttcgtagatgagatcaagacgcgcggtaacgatgctgacgggtcacaagccttggctaattatgatgctgcaaccgaacaattacgcgatcagctgaacacggctaatgataccgatacttcagcagattttgatgacatcgttcttgatggtaaaagtgcgtttgcgcaggcgaaagacgatgatgagggtagtgaaacccgcaccgatgaagtgcctgaaccgacaaaaccggtcacgattaaagaggcaccagcagattcggcagcggcagattctcaagcagcagataagtaattatcagctttttgatgattaaagatggcggcaaacgaaaggtaactccgtgtgagtacccttcgcttgtcgcttttcacatcgtaacggtcaaggcgagccgaattggctattttggttagaaattgagggagtaacatgttaaacagtgaacgtcaggcgcatatcaaggctgcattgagtacggcagctgaaccgctcagtgcatcgagttttgcacgccgatttacggtcagtcgccaaacgatcgtcggggatattgcactattacgggcacaaggcgaacccattattgccaccccaagaggctatacgttatcgcaaccagctgcacttgaatttttggttccatgtaagcatacccccgcccaaaccgagcaggagcttcaattgattcttgataacggtggctggattgaagatgtgttggttgagcatccgttgtatggccagttacgcgggcaattgaatattcgtaccgttgccgacatgaaactgttcttgagtcgggtcgcgcggtatcatggccatcttttatcagaattaacgggcggtattcatttgcacaccattagtgtcaagcagaaaagcgacattgcgaagattaaaatggcgcttcatcaggccggcatcttatatgagcagctggaggaagcagcggatcagggataaatagtttagtatctgagcttttaggctgaaagaaattggtgagtgaatctaaaaaaggttctagcaatgactgagcttgtcattgttagaaccttttttactagattgacatgtaacccacgatttcaaaagagcaacaattaacgtcacaagttaaccattaatgaccgtgaattcctttgatgtgtgcgtaaatggttcgcagccggtttccgtgacgtggacacagtcttcaatgcggacccccgccactcccggaacatagataccgggttcgatggagaagcacatgccgggctgcaagatcatatcattgccttccatgatggacgggaattcgtgcgtcgacataccgatgccgtggccgagccgatgattgaagtactcgccatagcccgctttagtaatgatatcacgcgcaattttgtccagttcggatgctttaagtcctggcttaacagcgtccatcgcggttaagttagcctcaagacagatgtcaaaaatttcccgtggcttaccagtgacttgaccaaaagcaactgtgcgggtcgcatcggacatatacccatgattgtcggtgcccagatcgaacaaaaccaattcgttaggtgcgagttttgttcccatcggttcgccatgcgggttggcagcatcgacaccagcttggacaatggtgccgaagctcatgtgcatgacgccttctttcatcatggcataatcgatttcagcggcgacttcttgttcggttgctccggctttaatggcattgaatcctgcctgaaatgcccggtcggcttgagcaccagcagcttccatctgtttgatctctgaagcggttttgatcaggcgctgtttttcaataaaacgagaagcatcaatcgggaaggtagcgtcggggaactgcttcatgatcgcttcaaatttgaaaacggcgagattatctttttcgattgcccattttgtcggattggggttgacggctttaatatgactcgccagttttgcaaacgggtcctcgtgatcaagataaccgaataccgggtaggcccagccggcttttttgacttcttcgatggtcagttgcggggtaaacaagaagggatcgtgatctggagcgacaattaaagccgtaatccgttcttctggatcttggaagaatccggtgtagtagttgatgttgatcgggtcgctaatgtaagcaagatcaaggccttcttcaccgatccaagtctgtaatgctgctaaatgttcgttcatgattttcctcctcaaaggacaaatgcaaaagtaaacgtcaaaatgacatacctgattaaacagccactgggtaagtcaatttcttgacgattcatcatgtcctgtggtgtgttgaaaacagttggttcaggctactccttaaaactcgctgctggcggcttagcaagcaacataaacgcaactttacccatcagtataacacggagaaaatgctaaaactttctgaaaagcctatttgtgaaaatttcatggaaaaatcagtaaaacgcttgcattgccgttctggttctgttattttggaatgtaaatagaggtttcgtgaattttcattttcacgactaaggagaaaataaagtggaaaaacaaacaattacaatttatgatgttgcccgcgaagcaaatgtgtccatggcaacggtgtcacgagtcgttaacggcaatccaaatgttaagccggctacgcgtaaaaaggttttggaagtcattgagcgccttgactatcgaccaaatgcagttgcccgcggcttggctagtaagaaaaccaccactgtcggcgttatcattcccgatgtgaccaacatgttcttttcgagtctggcgcgggggattgacgatgttgccaccatgtacaaatacaacatcattctggccaattcggatgagaataaccaaaaggaagtctcggttctgaacaccttactggcgaaacaagtcgatggtttgatctttatggggcacgagttgacagatgcgattcgcgccgagttttcacgcagcaaaacaccggttgttttggccgggtcaattgatcctgacgaacaggtaggcagcgtcaatattgattacgtggctgcggttgaagaggcgaccagacagttgattgaaagcggcaataagcgcgtcgccttggcaaccggttcattgacacatccgatcaatggtcaatttcgcttgaaaggctacaagcaggcacttgaaaaagcgggtgttgcttacgatgaaagcctgatttttgaaaatgaaccaagttatcaggctgggttggccttattcggtaagttgcaaaaggttggcgcaacagctgtcattgccggcgatgacgaattggcggttggcattttggatggtgcgctggacaaaggcgttaaggttccagaagacttcgaaattatttccagtaacaatacgaagctgacggaaatgacacggccacagttgacctccattgatcaaccattgtatgacattggtgcggtggcgatgcgcttgctcaccaagatgatgaataaagaagaaatcgaagaaaagaccgttatgctaggttttgatattctgaagcgtggttcaaccaagtagacagaagtaacacgatattctggcggcatgccaagcaagcatagacgataaaaagcagatgaatcagcgcatatatggcgcggttcatctgctttttggtttgttggtatgataaagatcaatgctgccatccgcacattgcttagacggtagttaatcagttaatggccggtacctgtattagttgacggggtttgcggagtagtcgtggtaccgcctgttgtcggtgcagaactggtggtggctgcttcagtgcctgtaccgccaccggttgtgccattgttgccgccagtaccggtagtttgcggctcactcggttgattttccgaagtgccttgttggttttgctgacttgatggtacggtcacgctaggtgtgcgactgctagaagctgctgctgatgaaggggtttctgtcgtaatcggcgtttcctgatgttcttttttagcctcggtggagcggccgttagcatctgacacttggccataaccattgcttttaccatcaagataatcgtagaacagctgataattatctttactgccgccaattgcaaactcggccttggcagttggctcccagtcattataaaggctggtcacagttgagccgccagtacggtaggtgtgtccgttaaacgaaagacttgcagccggctgaccggtttgtttatcaacggtgacggatttgacggtgctcggtcgacttagtttcttatccgctttgaattttttaggaatggtatgatacaccgcattggccagttttgcccaatatgcttcgttggtcatcgagctattttccgtgagggtatagttcgtgccattactattatcgtaccccatccagctggcaatcgtgatgcccggggttgagccgatgaaccaaatatcgcgaaaatcgttactggtcccggttttaccaatcagattatcggtattaaatcgcaactgatagttcaggctttccgcagttccggatgcaaccacgtttttgagcatctggttcataatgtagttggtgcctttagagaaaaccttggtctttttgacttgatgacgataaacggcatggcctgagggatcgacaatttcggaaatgacgtaggcgggaacatgttcaccttgattggcgaatgttgaaaaggcgctggcttgctccttaacgtcgaccccgtaatcagtacccccaagtgccagaccaagttgactatagtcattgtcggtcagggtgttgatacccatcttttccatgtaggctttgacgtttacggatggcttgatatgtttatatagattaacagcaggaatgttataggattgtgccagtgcttcagtggcagggataaagcggttttgaatctggccgccatagtcagtgacgctgtaattgttcccgagattggttttgaaatcagctaaggcagtttgcgagccgataattttttggtcaatcgcaggggcataaaccaaaagtggcttgatcgtcgaaccgggggaacggagggtataaatatggttgagttcgccggtcacgccgccaacaaagccgagaacggccccggtttgattatcaaggacaaccgatccgttttgaaccggatatttaacggtttccgtttcaccggttttcggattaatctgactactggtataagtttgaccgaacgtatcacgggttgcgcgcatgacaaattgcatgcgatcataaacatctttgtcaatcgtgctcttaatgcgatagtttttggacgcaaaaagatcgcctgcctgtcgaagataatcattgtttaaagcgctatcttttgcgagttctgctgcagaatggccatcgctttttgctaatttctcggctaacaatgatttggcttcacttagtaccatgttatagacataaccatactcatcgtcatcctggtctgctttttctggctggagaaaggcaccctttaaatcaaatgatttggcagcaacatattgacgatggctgataacgccagcccggtacatgcggaagagaacggtttgttggcgattgataccggctttgagactggttttcaatttaccatcggctgtgtaaggggtatagacaaatggactttgcggcaggccagcgatgaaagccgcttccggcaagttaacttccttagccgaaaccccaaacagtccttgagccgctgcttcaactccggcaatattttggcctttgttattacgaccaagcgtagcaacattgagataagttgccagaatggtgtttttactgaagtgattgttcaaacgccgggccagcataatttcagcagccttacgtttaaaggttgtctccgaatttaaaaacatcattttgaccacttgctgcgttaaagttgacccacctgtctgactccccataccggttaagtcggagaagaacgcacggataaccgccttaggaacgatgccgttgtggcgatagaagtcttcatcttcagtggcgataatcgccttggtgagccatggcgacatctcattgaggttgactttggttgagtacaggtcgcttttaacatcgctaagcttgacgttgtgggcaaaatacatgctggaagtgcggctggtattggacaacgttgctttcatagcagtttcagttggaattggcgttgcgtcaataatcgacacaaaatagccgccaaacaagccgaggccaaacacgacagcaatgcctaaaacgcctaataaatagtaaacagttgttttgatgctttgaagtgtcacgttgccataatagacaacggtagctttacctgttagttgttgattggtatctgctttggaatcgggatgccgggtcacgaattgcgtgaaccagcgacaaaatcgagtcccaagcgtcttgacccgattgacgaactttttcaagtgcttgtcccaccttaaattttggtctagtacgccttagtataccttaaaaacagggcggattctaatgctgtaaatggggagtgccaagtgaggtgtttggaggtttgaatgtaaggatcgttaggcttggggtggtggtttttttaggggggttacgcgtgcgcgccggtttacgttctgctctaaaacgcgttcacagtcgcagaaatctacgtgtaaggacctcagacgcaatggacaaagcccggccatcacgtctgaggccacttacactccgatttctaagcgctcctgttcacgctctggtctgaaacgcgttcaccagcccagaaacctgcacataaggaccttgagcgcaatggccaagcccgggccattgcgctcaaggccacttatgctccggtttctaagcgggttggttcacgctctggtctgaaacgcgttcaccggcgcaggagtctgcgtgtaaggacctggaacgcaatggccaaaacccggccatcacgtcccaggccgcttacactccgactcctaagcgcgccggttcacgctcttgcgacttaactttcattgtgtaagactaatagcatatgtcatgaatgagagaatggagcaggttatgtatcgaattattttgtttgatgtggatgataccttgttggattttaaggcaggggaattaaaaagcctggcaaaaatgtttgccaagctgaaattaacgtacacaccgcggattgaagcgagttatttaaagataaatgccaatttgtggcgcgattacgaagcaggtcgtatcactaggccggaactttttgaagtgcggtttgccaagttatttcggcatcatcgcattgatgctgatccgcacttggctgaacgcacttatcaccactttttggaccaagaagcgatcttattgccacatgttatggaaaccttggatgcattaaaagattatcgactcttcattgttagtaacggtattgagccggttcagcgccagcgattggccaccagtggcttgattgattactttgaggatatttttgtttctgatagtgtgggtagtcccaaaccgactgtcgcgttctttgattatgtcgctaaacgtattccgcggtttaatcgcaacgagacgttgattatgggcgactcgttaacctcggatattcaaggcgggattaacggtaagattgattcgatctggtttaacccgcattttcagccgaatcgcgatcaaattaccccgacttaccaactgaacgaatttagtgatctaactaaattgctcttggctaattaacgactgcctgaactgattagtcggctaggcgaatggtgccgctcgtaaccaccatggtaccttgggccgtttgtaacagtaaggcaccattgtcatcaaacccgctgatggttccggtcagcgggttttgtgtgccactcaccgtaattcggcggccaacccatgcagcttttgcgcgataaatcggcataatggtttccggattggcaaatagacgcatcagattggttaaaaaccgccctgccagttctggacgcggatcgctatctggttgattggaaagtaacgtggtgatcggctggtcggttggcagcactgctgattgagccggaaaaagatcaaccccgatgcctaagaccacagcgttgtgttcaatgagtgcttccgctaaaatacccgcaaccttgcgaccacctttttgcagatcattcacccatttgatcgcggttacaatgccaaactgggtttcaattgcctgctgcaacgcaacccctgcagctggtgtgatcagggactgactgatttgcggatggaatgcgtaactaagataaagccccgcatcggcaggactggcgaaatgtttgccgtgacggccgacaccggcagtttgttcaccggcaataagaatttgtgggactgtgctgttattttgaacggcgtgttttaaaacggtgttggtagaggtcactgttgcctgagtagcaacggctgcacgcaaatgaggatcgtctaaccatggatctaaagcatgaggtgtaaacatcataagcttcctttctgatttgcatcgcacaaacgccaggagtcaccgcaacattgtgagttgccgacttctggcgcttgggttgcatgattagtttaaagagcgtcaaggcgttagtgttcgcagcgcaatcaagcgggcaaagtcacttcactaaccggctaattgcatcggcatagatggcgactgctgccacaatgtctttgatcggcatatattcatttgcctgatgcatgacattttcctggcctggcatttgggcaccaaaggcaacaccgcgtttgatgatacgaccataagtgccaccgccaatgacttgttcatgaccggggatgcctgtgtgatcgctaaaagtctgaagcaatgtcttgacaagcggatcatcaccggatacatagtgtggttcctgagcgtgaccgctgactgccacattgtactgatctgctcctagcgccgtttcaatctgatcacggattttggctgcatcggttccttgcgggtagcggacattgaccagaacgctttggggaccgtcttgcgtaaaggtgaagatatccggacttgctgtcaggtcgcccattagtttatcggtataattaatccctaaattgtgaccacgtgagtctagatgaaggtggttggcaatcatggtcagataggctttcccggctggatcaaatggtaagtcggccaaaagcgttgctaaataggttgcggcgtttttgccatcttttggttcttgggcatgggcgccttttccaatcaattcaatcgttgtcgggttgcctggtgtcagagtgaaggtgacttcttgctctgttgtccacttctcggcttgcgtcacaaatgcttccggtaatggcccgctgatgacagcctttgcttcttgtggcaccatgtttggccgaataccggcggaaaaatgattcaacgttagatcagcggttgcagcggcgattggtttttgaacgatttcaaaactggcaatccctttttcgccattgatgataggaaattccgcgtctggtgaaaatccgaagtcgggagcaggttcagtttcgagatagcggtgaataccgacccagtcagactcttcatcggtaccaagaatgaagtgaatctttttattaatcggcaacttgagatcgcgaatgagctttaaggcatagtaagcagcgatacttgggcctttgtcatcgcttgttccgcgcccataaatcttgccatcgcgaataacggggtcaaatggatcggtttgccagcctggtcccgcgggcacgacatcaacatggccaaaaagcccaaagatttcgtcgccatcgcctaattcgatgcggccggcaacatggtcgacatttaatgttttgaaaccgtcccgctgtgcaatcgtcaaaaatgcttcaagcgctttggccggtcccggtccgagtggatactcatcggtttgatggtcagtatcacgttccgaattgatcttcaaaagtgtggttagatctgagagaagttggggttccaatttttcagcttcttgctgccaattaatggtcataaggttaacctactttcttactagtgttgccttaagaatagcatgtttaaggcatagaaacgaatgaatgactcgatcattgataatgcgtagtgaagacagacaccgcgcctattgatagggcaactgaagtttttaaccgatgttcaggacactggcattgagaagcggtgtatcgaaggccgtgtcgccaagtgcccagtgaaggagcggtttttggttttcggggatgctgcgatagagcgtgagccagatatgcatattctcggcggttggcagcacctgtaaatctttggcgtttaaccaaccgatttttgtttttaaatacagctggccgctttgataacgggctgctaatacccggtagcatttgtgattgccaacatggccggtaatggcttgctgatgtaagggattggcgtgcacaggtaccttaaagtgtcggctagcaatgacgatgcgctgatggagaaaaagacttgcccaaccggcttcaggggcaaggttgatggtttcggccgggacaaacgcattatcgccaatttgatagtacgtactgccagcgagtgaaaccatgctggaaatcatgatcggagtttgcggtgccagccgttcagagcgcaacaatggctgataaggattttcataaactggcagtgcagcaaggcttgagtttgccccaagatcattgatgctggtggtgacagcagctgccttaagcgtttgaaactcgtggccgaggctggtgtaattagtgacgacgccatcaatgttgagattgacgagccaagtccatttcgcccgatcctcgttcatttcatcccagacataaactttcttaccaagatcatgcagttgggtgacaagttgcggcgtcactaaatcggaacttagattaataccgtccacgtacgtcaagacgtcaaagttgatccgcttaagcgagccaacgatcaaaattcgcggaatatttggcagagctgcctgcaagcgtttgaggctagctgctgagaatgaatgaaacatcacgcgattttccatgtgatactgcttgatcagggccgcaactttgtcttctagatgcggatgcggttcaccttttacaattttagtttcaatcaggaatttatgctttgtttgttgctcatgggcgaagagttcctctaggctgtgaatcggttcgccatttttggtatgatattgctgaagttgtgcgaagtttgttttcgcgatcgccaagttggcaccagtcgttcgctgaatcgtggtgtcatgttgaatcacaatcacaccatctgcactttcatggacgtcaagctcaacgtaatcagctccgttgttaaaagcactgtcgaaactttgaaaggtctcttccggataatttaaaggatcaccacggtggccaactagcgtaaaccccgaaagcagaagaaataatggcactaaaaagactatcagtgtgagtcgtttgcccatacaggctgctcctttccagaaaaaaacatcataccacaaagatagcaccgcaacgcgactgggacaatttcccatacttcgtgaaatcaaataaggagccttaattgaaaatggcagaaaaatatcaggttttcgatttaattcaggaaataacgcgtcttgacgggagtcgttatttcgagttagggaacgtcatgatgaatggacgtgccgaaaaagccgcgatgaagggatttattaagcgggtccggatcgttcaactgaatattgcccattcgacggccgtgacgacttatgaaaaatatattaatgaacattacgagtttccaccggccgatttaacgagttgggaagaatgggacaagccggagggcccaattcgtgatgcttatcatgagattctcaagcaaaatcacgtcggttaatgggctgctgcattcacttgtctcggtgaaggtacctgtcagccgaatattttaataaaaatatcaattttaaatgaagtccagcatcattacgggtgtaggcgcgccattttagaacttccggtttaaaccggtcggggattttgcgttggattgacgccacttatataatgtaaggcatatgaaagcgaggggtccgcgtgaaatacataggtaaatggctactgccgtttatagcggcaattgcggtttttatcggcatgcagtttgatagcggcctttataccaaaccgattgggcgagtcgaagccgtgaaagtagtcaagaccgagagtcatcaggatgaagaccagaatcacgatcgtctggtgaagcaacaggtgcaggttcggctgctgaatactgctaaccgggggcggcgggtcaccatgcataatacctacttgtttagcggcggcttggataatcagctgcgggttggtgagcaggtgtttttggatgtcaataaaggcacctatacattgaacaacgtcaaacgagacgcaattctggcgggacttttggtgctaacgtttggtttgattttccttgtgatgggacggcgcgcttggttaacgagtatcagtattttgctgaatacgctgatcttctttgcggcagttgaatgggaaattggcagtaaacagtggcaagcctggtggttgtttgtcgggttagcggttgtctttactgttttaacggctgtcttcattgtcggatttaaagcgattgctgttgctatttctttgggatccttggtggcgaccggactggcagtggcgcttggttacgggattatggccatgacaaactataatggggttcattttgaagaggtcaaatatgctacccaaacgccgcaattgctgttctttgctcaagttgttatcggttctttaggagccgtgcttgatgaagcaagtgatatttcggtcgctattttccagcttcacgagacggctaaagaacgatttcgcgccggcatggccattggacggaatgtgatgggtcccttaatttccgtgcttttcatgatcttcatcgctgatacgtttatggagtcggttttgtggattcgcaataataattcgatcgcgcaaacggttatctgggtgatgggacttggttttgcccaaagtctgattagcgcattcggtattgtcctggcagtaccggtgaccagcggattagcggcgttaatggctaagattaagaaggtgacagcatgaacgcgattcttgcactagccttggtgttagtggtcatgatgtttatcgttggcggcaagcaaggcttagcgaacttctttgccttggctgccaatgccctgcttatgattttggtcgtgatattaatggccagcgggttcaatccgattattgtcgcggttatttttggcttaatcattttagcggcaacgatctttttgagcaccaatcagcttaatgttgctgggcctgcgtttgtttctgctttattgatcatgacgttgctggtcggtttgattttggtggtcatgaccttaagccagacagccggtttcgggccggaagattccgagagccttgaaggtttctcggtgtatattggggttagttttccacatattctgattgcaacaactttactgggcacgcttggcgccattgctgaagcggcgattgcggttgcagccgggatggacgaaattaaggaccaagcgagcagcgcgggcattaaacaaatgggtcatgaaatcattggaacggctttaaacacgctgttcttcggtttttttggtggtttttcttctttgtttatctggtttgcttcccttagatatcctttttcacaagtgattaataacaaaattttcgttggcgagttattgcaggtcttgatttcggttattgcggtgatcttaacggtaccgatgaccacctgggttgtggcgacaagacatgcacatcgtcggaaggagtaacatgcaatactttattgcggacacccacttttttcacgcggatcttttaggtgataatgactttgcaccgcgactttttccatctgtagaagcaatggacgatgcgatgattcaagcttggaatgcacgggttgacgatcgggatgtggtgtatcatttgggtgacattgccatgaatccggagcattttcctcagccgccggaagttttggcgatcttgttgcagcttcacggtcgcattgtttttatcaagggcaatcatgattatgaatcgttattcaaatatctgcaccggcatgacccgggcgtaaatggtttgcctaagttcacgtttcattcggttggtacgattatcaaagacgatcacacgcaatttattatgacgcactatccgctgatgatggggattgtgaagcagacgctgaatctacatggtcacattcatcacaatagtgtcaacattgcggaaaacatcaacgtcggcgtggatgcaccggagcgcgatttactggtgccgcatttgcctttcgggacgccactgacggcagctgaaatacatgagatttatcgactaaaggttgcagttttgagtaaggaacggtagcaatcagcagtggtttgaccggtcgcaatttcgggcataggatgaaattagaatggattgatagcaataccttgaaaagatgctggttgcaaggagtctaaggaggtgccttgtggagaagttggtgatcctgcacacgaatgacttgcattcccactttgaaaattggccaaaaattcggcgattcatgttaggaacacgggcggctgagcaagcgcaaggagctagtgtcttagcgtttgacgatggggatgccatggatcgatccgtgccactaaccgaggcaaccgatggccagattaacattcaattgttaaacgaaatcggttatgacgcagtaaccattggcaataatgaaggcgtcggtaatccgcatgcagtgctggaacatttatatgatcatgccaattttccggttgcacttgccaatttatttgagccggatgggaccagaccacgctgggcaaaaccggttgttatgaagcagacaccagcaggaacccgagtggcgattgtgggctttacggcaccgttttttctcacgtatgaaccgaatggctggcaggttaagacggtggcggatgttttcccggcaatacttaagcagctggagggttcgtatgacgttttggttgttttgtcgcatttaggcattgaagccgaccgacatttggcgcaacattatccgcaaatagacgtcattatcggtgggcacacgcatcacttgctccctgaaggcgaattgcatggcaccactttgttaactgccgctgaaaaatatggtcattatgttggaaaaatcaccttaaccttaaatgatgaccatcacattcaaacgcggcgagccgaaacttttcaaacggctttgttgcaaagtgccgcggcggatccacgtgaaattcaaggctatgaaagtaaaggaatcgccttattaaaacaacagcaagtcgcacgtttgcctaaacagctagccattagctacgatcggccatcgccactgcttgattttggtttagccgcggtggcagcaaccgctcagactgatgctgcaattttgaatgccggcttgtttttgacccctcttggccccggggttgtcacccaagccgatttgttagcttgcttaccgcatccgatgcatttactgaaggtgactttgagtggcaaggaactttggcggctgatcatggaaatggaaaagaatcggatgtttttacgacattttcacatgatcgggatgagttttcgcgggaaaatttttggcgatatcggctatcgcgggataacggtggatcgggagaagcggtgggttttatggcaaggtgagccgctgattccggagaagcaatatacgtttgcgaccgtcgacaactttttattcattccatttttcccaaccattgagattatgggcagtaatgaattgcttttccctaaaatcttgcggcaggttatcggtgactacatggcaaaagtttatccaagatagtttcgtgttatacttttgggaacacccacgcaaggactgctatgtacgtgcggcgatgataagccgcatgaaacgatttttagatgaaaaaggaggtcatgacttgggtgaacgatcaccattatccgaacaaatcgatgatgccttgataccggctttaaaaaaagatttacgaatcgtcaaggtcgggcacgatttgatcacgatcgatgggcgccggtatcggattgtcgagaattatcgggatgcctgcgatcttgagcgattaaatgaacgctataatgatattcttgataagtatgatttcattgtcggcgactggggatatgaccagttacggcttcggggcttttataaagacgatcgccgtggtgccagcaaagatcagcttatcagcacattagaagattacctgtatgaatactgtaattttggctgtgcttactttgtgcttgcgtgtctagacaagcccgcccctaagtcgagtccccgccggcaaggacgcgatcagcattcgcaaacgactaagaatgcgcagcgtaaacatgccaataagcacccattccatggcaaacgtaaagcaaacaaaccatacacggaaaagtcagttcgatcaccgcaatttcgcggcgaacaggctaaaaccgtacaccaaaaccaaccacgcaaatggcattttacgatccgtcaacgtgagactaacaagaagtagggacagacttgaagtataaaggttatatgattgatctggatggaacgatttatcgggggaaagaacggattccggcagcaaaggattttgtcgaacggctgcaagcagcgcggattccgtttttatttttaacgaacaatacgactaaaagccctgaagatgtcgttgataatttagccaaaaatcacgatattcatgtcacacctgatcagatttacacgccgtcattggcaacggcggcttatttgacggatcttaatcacggcgatgtttcagggaaatccgtgtatatcatcggtgagctgggcttgaagcaagctcttttggataccggattacggttaaatgaagtggatccggactatgtggtagtgggcttggattatgatgtcacctatcataagtttgaattggcgactttggccattaagcgtggcgccaagtttatcggcaccaacgcggataccaacctgcccaatgaacggggattagttccaggagctgggtcactgattgcattagtagagcgtagtacccagcagcgcgctttttacattggcaaaccggagccgacgattatggagaaagcacttaaaaaaatgggcttgcctaaagactcggttgccatggtgggtgataattacaacaccgatattaaggcgggattaaacgcgggcattgatacgatcctggtttataccggagtgtcaacgcgtgattatgtgtctaaacaagttcatcagccaacgcaccaaattgaccagttaacggactgggaggtttagatgaaacgcgctgggcagtgggtggttctttggctggcaataattagtaccgtcattttggttacgatcctgagcacgctgctgacgtttccaatttatgcacatatggatgacttaccgcaaattgccgctatgtcattaggaaggctttaccacaattacttacaattgatggcttacctgaatttcccttggattgggacacttcgaatgcaggattttccaactagtctgcatggagcggttcactttgctgacgtgcgtcgtctttttattttcgatatcctcgtggccctcgtaacgctgccttttgctattcgttggctacatcggctcaaaatcacgagtaagcgttacttgttggtgcgaccgtttatgatcggggcagtcgtgccaatcgggttaacggcactattggcaatgaactttgaccggttctttattgtttttcatgaaatgcttttccggaatcaggactggctgtttgatccggcaaccgatccgattatcaatgttttgccggaaggattcttcatgctttgtttcctattagcatttggtttgtttgaagcagtgatgatatggggcatttggcgaggacggcaagacgcacggctcgggtcaaagcaatagaaaaggcgcagtacatgttgtttataaacatgcgttgcgcctttttgttatttgatgattagcgatcagcgactttggcagtccgggttttaaccgcggcaatgaccattggtagaagtgagatcaagacgatgccaagcgcaacgagtgaaaagtgttcttttacaaaggtcacattaccgaaatagaagccgccgagcacgcataaggtgacccataaaaaaccgccaagtaaattgtagtggatgaacttaccgtagtgcatacgggaaccaccggaaacaaatggggcaaaagtacggataagcggcatgaaacgggcaattgcaattgttttaccgccatgcttatcaaagaaggcctctgcttggcgcaacttgtcacgattgatcaagcgcccgaaccagcctttaccggtagaagcagcagaaccgacacgcttaccgatttcataattaacagtatcgcctaaaaccgcagcagccaagaaaaccgcgaagagaatccagacattcaagttgtaagccgcgttggcagctaaagcacttgcggcaaacaacagtgaatctccgggtaagaacgggaagacaacgaccccggtttcgatgaagaccatcgcaaagaggatgacgtaggtccaggggccgaagctattgacgatggtgatcaaatgttcatcaatgtgtaagatgaaatcaaacaactgggtcattttgtaaactcctttaatgaattatctttcattatacgggataagatgaaagtttcatgaaacatgcgaaaattttagaaaaacatcaataaatatcgtcttcgatttccggatgggagtgggcaaggcgactggcagcagcggcagccattgccccgacgatatcatcaagaaaagtgtggatgatccccggctcgtgggcattgagcttggccagaattcctggcttaatccgatcaatatagccgtaattagtaaaaccaattgatccataaacattgacgattgaaaaggccaacacctcatcgaccccataaagtccttcatcttctgcaatgatcttctgtaaaggctcctcaagactgtttgcttcagcagccttatctaaagcgataccagtcatcacggcattttgaacctcccgtttacgcaaaacaatgcgaacgttttgggtggcttcttcgatcgtcaatttaggaatgaaccgttcctgtaagaacatgacaagttcaccaatatcactgagttgcacaccgcgctcgtgtaataactggatcgtgcgttcatacaatttctcttcatttgtcatttttcgcttctccgttcaaagtgggcgttggccagtgtgcttagcagtcggtactggcgaacacattagcggcattaggttgagttggctggttttatcgataaagttgggtactgtgcaaagcttgacggcgttccgggtaaagccgactgagcgcttcgttaatggcagtcggtgcctcaccaaagccgctggcaatcaatggcaactttccggcataactgacggcatcaccaatcgcaaaaattccgggtcggctggtttgcatctgtgaatcaaccaggatgccattacgatcggttttgaactgccatgcttgaagatgccgtttgtcagtaacaaagccataattaaccagcaatttgtcgactgttaaggtgggctggtcctcaccacgaacttcttttaagcgtacagccaggcgcttattttcgtgcgtgacggcttcgattaaatacggggtttcgatcgtcacactactcttttcaagtgcagccacactcgcctcaagtccgcgaaatttggagcggcgatgaattaaagtaacatgccgggcaatcggctctagcgccaaagcccaatcaatggcagaatcgccgccgccagcgatggcaacttcctgatcgcgaaaagtctccagatcttgaacaaaataaaaaagttgctgaccttctaaagcggggtcataatcaacggctaatttacgcggcgtgaaggcaccgccaccagtcgcaacaatgaccgttttagtgtggaaatctccttggctcgtatgcagaataaaagtgccatcatcagcctcgtcaattgtctgaacttcagtagctgttttgacgtccggtttaaaatgcatcagctgagtcttcagttgagcgaccaaatccttaccgctgacatgagggaagccgccgatatcataaagaattttggccggatataaatttccggtttgaccaccgagttcatcaagactttctaataataagacatccgcttgacgtagcccggcataaaaagcggcgaacatgccgaccgggccgccgccaatcacagtgatttcatatacatgctgcactgacatttgcaatgctccgtttctataaataatatgacgttcataccctaccatattttgctaatggttaccaaggtgacagtagtctggcaagcctgtttaaccagatatcaccattgaagggttcattgactaagggagtgcgcaaagcaaatgacatttactttgcccatattgatgatgctggtatactacgcctagtgttagaaatacgaatgagacaaatgaaggagactgattatggactatccacaactagaacttgcagaattcaagggaccaaaagcaatttttgaaaccagcgaaggacattttgagattgcactatttccaaaacaggctcctaaaaccgttgagaacttcatcggtttaactaaaaaagggtactacgatggcctgatttttcaccgcattattgccgattttatgattcaaggcggcgacccgacaggcacgggaatgggcggtgaaagcctgtggggcaaaccctttgaagatgaattttcaaatcaactatttaatctaaaaggtgctttgtcaatggccaacgcgggtcctaacaccaacggcagtcaatttttcatcgtcacgaataggcatctggatccgagcatgaaggcacaattaagcgaagccggatttcccgaaccgattatcaaagcctatgaacaaggcggcacaccgtggttagatcatcgccacaccgtttttggtcaagtgttatcaggactatcgattgtggagaaaatcggtcaagtcaaaaccggtgccaatgataagccagttgagccggtgacgatcgatcggttgacaattcaagactaatattggttgccgctgatttttagggtatactcaaagagaaatccaatgaaatgaagtgtcagaatggaatatcgcataggagatatcttgactggcaaagtgacaggggtccaaccatatggggcgtttgtcatgctggatgagcacacacaaggtttagtgcacatttcagaatgccagcacggttatgtcaaggacaccagcgatatttttaacgtcggccagcgagttgaagttgtgattttggacatcgacgaatatacccaaaaaattagtttatccttgcgtgcgttgcaagcgccgcctcggttaggtaagaagcggcgtcgcaaacattactggaccagtcgtaaatttcacaccggctttgcaccgattgccgctcatttagatgggtgggtcgctgaagcacttgaacacttagatggagaaaccactcataaatgagcggttttttctttacgcttcatcagcaatgcaggcaaatgaggcgggcatagattgttctagtttaattaaatggcattaggctgttcatgataatgaagttagggtattgcgagaatgtggtcagccagtttgcaaggttgatgcagcgaatttttagaatttgacattaacgtggcaattttgggttcacgatacgatctttagcattttgaggagatgcacgctgccttagagcttagtgtaaggagatcatggattgatgcaggacactaattgtcgttgtggcaaatggaaaacggaatgccccacagtcgttcgcaagtgtcatcaaacgttttagtgaacttttaacacgttctcccaccaattgttcgcaaaatatgcgaatttttatgcattttaattgctaacgttcgttgtttttcggaattggaatttattttgatttatgtcaattttttgttgactagttcgcgcaagtgctggtatgatacttgttgttgtcaaaacaaagacgtcgttccttgacggatgaactgatgagataaagttgatgaatcagcaagatgtgcatcattttcaataaattgaataaatattcaatttaaaaagttgttgacatgatatgctgatcatgataatctatcaaagttgtcttttgacaaagtagtcctttgaaaactgaacaaagtttcgtttaaatgtgcagggtccttgatacttcggtatcgaggcaaaaagtaacatttgcgaagtcaattcgctagaacaacaaatcgagctattcgaacagctcatatttatatgagagtttgatcctggctcaggatgaacgctggcggcgtgcctaatacatgcaagtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactggaaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcgggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggattaccctcaagcaccctagcgggtgcgactttgttctttgaaaactggatatcattgttgtaaatgttttaaattgccgagaacacagcgtatttgtatgagtttctaataatagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcctgcaagtgaatacatagcttgttggcggcagacgcggggaactgaaacatctcagtacccgcaggaagagaaagaaaactcgattcccatagtagcggcgagcgaagtgggaagagcccaaaccgagaagcttgcttctcggggttgtaggactggacattggagttaccaaagttcgacgtagtcgaagtcagctggaaagctgcgccatagaaggtgaaagccctgtaaacgaaacggcggactctccgtccaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaacagttcctgaaaccgtgtgcctacaattagtcaaagcccgttaacgggtaatggcgtgccttttgtagaatgaaccggcgagttacgtttgcctgcgaggttaagatgaaaagtcggagccggagcgaaagcgagtctgaacagggtgcttcagtaggtagatgtagacccgaaaccaagtgacctacccatgaccaggttgaaggtgtggtgaaacacactggaggaccgaacccatgtatgttgaaaaatgctgggatgagttgtgggtagcggtgaaattccaaacgaacttggagatagctggttctctccgaaatagctttagggttagcctcggaggatggatcatggaggtagagcactgtttgaactaggggcccgtcaagggttactgaattcagataaactccgaataccattgatcttactccgggagtcagacagtgagcgataaggtccattgtcgaaaggggaacagcccagatcaccagttaaggtccctaaatttatgctaagtggaaaaggatgtggcgttgcacagacaactaggatgttggctcagaagcagccaccatttaaagagtgcgtaatagctcactagtcgagtggcactgcgccgaaaatataccggggctaagcataataccgaaactgtgggtgcacccgtcagggtgcgcggtaggagagcgttctaagggcgttgaaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgcaaggcgtagtcgatgacaagcaggttgagattcctgcactagtttattttgtttaagcgatggagggacgcaggaggctaaggaaagcgcacggctggaaaagtgcgtccaagcagtaagtccggtggcgagtgaaatgcttgccgccttaaggacaagctgtgatggggagcgaaattaaagtagcgaagttcctgatgtcacactgccaagaaaagcttctagtgagaaataaactacccgtaccgcaaaccgacacaggtagtcgaggagagtatcctcaggtgagcgagcgaactctcgttaaggaactcggcaaaatgaccccgtaacttcggaagaaggggtgctgaccgcaaggtcagccgcagtgaataggcccaaacaactgtttatcaaaaacacaggtctctgctaaatcgtaagatgatgtataggggctgacgcctgcccggtgctggaaggttaagaggatgagttagcgcaagcgaagcccagaattgaagccccagtaaacggcggccgtaactataacggtcctaaggtagcgaaattccttgtcgggtaagttccgacccgcacgaaaggcgtaatgatttgggcactgtctcaacgagagactcggtgaaattatagtacccgtgaagatgcgggttacccgcgacaggacggaaagaccccatggagctttactgtagcttgatattgagtgttggtaccgcttgtacaggataggtaggagccgtagagatcggaacgctagtttcgatggaggcattggtgggatactaccctagctgtatgaacactctaacccgcgccactaatcgtggcgggagacagtgtcaggtaggcagtttgactggggcggtcgcctcctaaaatgtaacggaggcgcccaaaggttccctcagaatggttggaaatcattcgcagagtgtaaaggtagaagggagcttgactgcgagactgacaagtcgagcaaggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgttccgctggtgtaccagttgtgccgccaggcgcatcgctgggtagctatgaacggaagggataaacgctgaaagcatctaagtgtgaagcccccctcgagatgagatttcccattcctatatggaagtaagacccctgaaagatgatcaggtagataggctggaagtggaagtgcagcgatgcatggagcggaccagtactaatcggtcgaggacttaaccaagtaaagcgcaaactggcgctaagccagcgcgcgcgtttcgatgaaatacgttaagttccggcaatgtaaaccaacaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgcttacatatggaggattagctcagttgggagagcgtctgccttacaagcagagggtcacaggttcgagccctgtatcctccattgagccgttagctcagttggtagagcaactgacttttaatcagtgggtcgacagttcgagcctgtcacggctcagagaattattggttttaattggcggctcaagtcgatatttttgccgacttagctcagttggtagagcatctgtcttgtaaacagggggtcgaaggttcgaatcctttagtcggcatggcaccaataatttgataagcattttgtttcatgcggaagtagttcagtggtagaacatcaccttgccatggtgggggtcgcgggttcgaatcccgtcttccgctttccgagcacagtgccgagggtgtgcttggtcgaaaagttcctcggcattatcatgatttgcacccatagcgcaactggatagagtgtctgactacgaatcagaaggttgtaggttcgactcctactgggtgcatttaacgggaaatagctcagcttggtagagcacctggtttgggaccagggggtcgcaggttcgaatcctgttttcccgattggacgcttagtccatatgtttttctcgcggtgtagctcagctggctagagcgtccggttcatacccgggaggtcgagggttcgatcccccccgccgcgattgagcttggacctttagctcagttggttagagcaggcggctcataaccgcccggtcgtaggttcgagccctacaaggtccatctttacaggcgggccactgttcggtataatcagtttgttactgttatcgcgggatggagcagttcggtagctcgtcgggctcataacccgaaggtcgcaggttcaaatcctgctcccgcaattaatatggttccatggtctagttggttaggacgcctgcctgtcacgcaggagatcacgggttcgagtcccgttgggaccgtttgcggctcggtagctcagtcggtagagcaatgcattgaagctgcatgtgtcggcagttcgattctgtcccgcgccatattcataatcatccttatgcgggtgtagtttagtggtaaaaccacagccttccaagctgttgtcgcgagttcgattctcgtcacccgctgcggttatgatattgggcctatagctcagttggttagagcgcacgcttgataagcgtgaggtcggtggttcaagtccacctaggcccattgcaccacttaattttatatacacatggagaagtactcaagtggctgaagaggcgcccctgctaagggtgtagaccgggaaactggtgcgagggttcaaatccctccttctccgttgtggcccgttggtcaagtggttaagacaccgccctttcacggcggtaacatgggttcaaatcccgtacgggtcatggttaaatggagaattacccaagtctggctgaagggaacggtcttgaaaaccgtcaggtggatgtcaatccacgcgagggttcgaatccctcattctcctttataattatcgcgggatggagcagttcggtagctcgtcgggctcataacccgaaggtcgcaggttcaaatcctgctcccgcaattaatatggttccatggtctagttggttaggacgcctgcctgtcacgcaggagatcacgggttcgagtcccgttgggaccgtccctctcgatttgagaggaacaaattctataaaaagattcaaatggctcggtagctcagtcggtagagcaatgcattgaagctgcatgtgtcggcggttcgattccgtcccgcgccattatggaggagtagcgaagaggctaaacgcggcggactgtaaatccgctccttcgggttcataggttcgaatcctatctcctccattcatagggatatagtttaatggtagaactacggtctccaaaaccgtcagtgtgggttcaactcctactatccctgctttataatggcggtattggtgaagcggttaacacaccggtttgtggcaccggcatacgtgggttcgatccccacataccgcccttttattggggtatagccaagcggtaaggcaacggactttgactccgtcatgcgctggttcgaatccagctaccccaatttctccaactgccataggagaaatgcactcaacttgatgaatatggcggtgtagccaagcggtaaggcatgggtctgcaaaaccttgatcgtcggttcgattccgatcaccgccttatcttgcggctaaaccccagcaagacagagtgttagctatcattattatgccggtgtggcggaattggcagacgcgcgggattcaaaatcccgttccagcgatggagtatcggttcgaccccgatcaccggtatcacaggccccccctagaggggcttttttagtgctcagaaatggctttaaattgggattcttgttttttctgggcgcttaaaaatccctaaaaaaagatgcttttaccgactacttttgctttttggggggtattttgctaaaagtggtcggttagctcgtaattccaaatgacgctactccttgtgtgtcaaggtattgagagccttttgttggtcggcaaagtggtcgctggctatcataaaactttaacgttgttcgccgcttgtcttggagccaacttgtctatcagaggtttgtggatttttaaaatgatttcgatgttctcatgtctagagcgccgaaagacgaattaaacagccatacccttaacaggcaaatactactgtgagtgtggcgaagggtatggaagttcaaacttaggccaagcatgtctaaacgcatacttgcacgacggatttcgcagttacggcatcaccgttaactgcttcctcgtataaacagctggcgagtcacccaagaaagatagatgggagtcgctttcgcttaatttgtcagacgagatagattgggagcctttgtaatcaaggacgaatcttccttaattgtatgcggtgataccaacagatggcgttgagagagaactaaatctggcttgcgtttccttagcactcaagtacaacagatcgattgcaatgcttacagcgaaaattcaagcaaaaaattgtcccatgattgccttggacacggcaatcatgggacaatcttgaactggcctaagagctcacagcttgggattaatcttcccgtgtaaacttaataatctttgctcgtgagcgttctaaagcacgacggaaacgattgcttgtgggcgtatcaaacggatgcaagactgccgtctcaaacgcctcatattccaggggtgacaggttttctagaagctgaaaaaattcaacacgcatgagcaatccgtcttcgactgaacgtattgctagccgttcctgcaaagattcgagcgcactcgctttgaatggaatagcggtagcatcaatccgacgcttatgggcaaagtgtctgcgcaagattgaacgtaagtgggactgtaacaccattcgataatacggcccaaattgcgagccgctgctgccatcataacgcgcaacagcttttatcatggcaattctggcctcttgcaaccaatcctcataggaaaattctctgaggttgtagggttttaaaacctttaaaaccagagggcggtattgttcgaatagtttacggaaagcttctgaatcgttcacagcttctcttatcaagctcagttcttcttttttcatatatcctcctcccctgatctactagcaagatcattctacaataaaacgtttacaattgaatagggaacaattgttcaggtataactttttatacaaggacatgtataagaaatcgcaaagaatcagcttttctagggcacaaaattattaacattattttcttattttttcaattagaatcaaagaatgcgtcccgatcaagttgaatgactgattagcgcgtggacatcgtgatccggtttgattggcacgtttggctaaaattggtatggtaaatagcctttatatgaggagactgtctgtactttaatagtgggctgaatggtacctgtagaaataaagtttaaaaagctgcccgatgcgtaaggaagagcttttgcgcttgatttaacgaggtgagttattttacatactccgtaatctgcggtaacctaattaggtcattttataaggaggtttccaactatttcttcaaaaacaaaagacaacaaaattggtctatttcagttagtcatgttggcacttggttcgttaatcggatcgggctggttgtttggatcgtgggaagcggcagaagtcgccggaccagcggcaattttttcttgggtcattggcggcgtcattatcggtgtcattgcctataattacgtggagttaggtacgatgtttccggagtcaggcggaatgagtaaatttgcgcagtattcgcatggctcattggttggcttcatagcatcatgggctaactggatttctttggtgacattattgccaattgaagcagttgccgcagttcagtatatggcatcgtggccatggaagtgggctgtttttacccacggctttttacatgcagggcggattaccccacaaggactgttagtggtctttgcgtttatcatcatttttacgttgcttaattactggtcagtgacgttgctgacgcgttttaccagttttatttccatttttaaaattggggtaccgttgttgacgatcgttttgctggccttgtcgagttttcaccccgaaaattatgggcattcgttggcaaccttgatgccttatggtagtgcaccgatttttgcggcgacttcggtttcagggattatcttttcttttaacgctttccagactgttattaatatgggaagcgatgtgaaacgcccgcaaaagaatattggtcgcggcatcgggatttctttgctcattagcggaattatttatattctgctgcaaagtgtctttatcacgaccatttctcccgatatgcttgctgctcatggttggaaaggcctgaaccttaactcgccgtttgcggatttggcaattttgcttggtattcactggctgtcggttttgctatatatggatgcgtttgtttcgccatttgggactggcgtttcgtttgtcgcctcgtccggtcgtgcgcttcaggcgatggtgggcaacaatcacattcctaagtttatcggtaaaattgacgaaaagtacggaactccgcgtgtcgcgatggtggtcaatgctgtcttaagtatgattatggtctctattttcccatcgtgggggacgcttgccagtgttatttcaacggctacgttaattgcttatctgacaggaccggtcacggtgatctctttgcgtgaaatggcgcctaatttcaagcgtccggtcaaatcagcgatgttgcgagtaatggcaccgttggcatttgtgttgacatcattagcggcttactgggcaaaatggccaaccaccgttgaagtcattggggttatcttcttagggattccgttgtatctgttttatgaatggcgatcaggttggcgcagtacctggcagcagttaaaagcctcggcgtggatgcttggttacctggtttttctctcggtaatttcgctgattggcagtgctgagtttaatgggttgaactggatccattatccaatggactttgtcgtcattatacttggcgcggtggtcttctatttctgggggatcaacagtcatatcatatcgaagtacttccgtaaggccgcgcgtgttaacgataaagttaaaatgcctgcagcggaagacatcgagcgtgacaagtaaccccaaaagtgaagatgttaatatgtattcataaatgaattaatagatatttcttcaaaaaagataggttgtaaatgactgattgtcgggatgtttcgcaagcggctgcttaaaaatttacgacttttgccggatgatgttcatctgatggcaaggtaagataattttaaaggtttgtgagaaaattgcatttagccatgcctatctttatacttatactaaacaaatgacgtctggaggggatcaggtgaatatcgggatttttacagacagctattttccgcaagtcagtggtgtcgcgacgtccatcaagaccttgaaggacgatctagaacgtaagggtcatcaggtttatattttcacgacaaccgacccacatgtgccagatgatgcggtcgaaccgaacttgttccgatttacaagtgtgccgtttgtttcttttactgatcggcgtattgcggttcgggggctgtttcacgcttatgcagtggctaaggaattaaatctggatattgtgcatacacaaactgagttctcaatgggttacattggtaagtttgtggccaaacaactgaaaattccaacgatccatacttatcacaccatgtatgaggattatctgcattatgtcttaaacggtcatctgctaaagccgtaccatgtcaaacaatttacccgcgcttttctgtatcacgtaagcggtgtgattgcgccgtctgagcgggtgtatgatacgttgcggcgttatggcgttaagaccgacattaagattattccaaccggagtcgatttaacgcaattcgcagagcaaaaggacccgcacttacgggaaaagctgggactggcagatgtgccggtattggtttcgcttagtcgcgttgcttatgaaaagcgaattgataaattaatcagcgccatgcccgcaattttggcgcaaattcctaaagcagttctcctaattgtcggtgatggccctgcacgtgaagatctagaggcacaggctgctgaattagggattgccgatcatgtccggtttaccggtgaaattgaccatgatgatgtaggcgactattatcgtgtcggcgatgtttttgtgtcggctagtgattcagagtcacagggactgacttatattgaggcaatggccgctgatcggaaagttgttgcccttgctggtgattatactgatcaactgttggatgatccggcgttgggaacaacttttacgactgaagcagaaatggttcatcaagttgtgaattatctgaagcatcctaatgcctatgatgatcccaaaccgcgaactgaaaagctggcggcaatttctgctgatcggtttggcgatcgggtacttgatttctatcgcgatgttatcagtcactattccccgaatgaagctgatgaaactgtgccatggaccgatgaaagtagtagcaaacggaccatgaaaggttaactatgatcgttattaacatgttttcttcagccaataaggttgctgggcaaggcgtgggtgcagtttacacagaactgatgggactgttgaaacacgattttgccaatgaatttcaaattaatgtcaatcgttatacgcgcagtgatattagtcattatcatacaatcgatcctaagttttatttatcgacgttctccaaaaaaagaggccgcaaaatcggcttcgttcattttgtgcctagtactttagatgcgagtttaaagttgccgcgagtggcgcggtggacactagaccgctatacgttagctttttacaaacgtatggatgaacttgttgtcgtgaatccaaacttcattcctaagcttgaggcctatgggattaatccggacaaggtaacgtacattccaaatttcgtttctcaacgtacgtttcatccggtttcccgggaaaaaaggcaggcgttacgacatgcgaatggttttaagccggatgattttgtcgtttttggcgccgggcaagtgcaagatcgcaaaggcgtcggtgatttcatcaaactcgcgcaacaaaaccctgattaccgctttgtctgggcggggggcttttcttttggccgcattacagaaggttatgagcggctcaaaaaggcagttgcaaatgcgcctgccaacctgaactttaccggtattatgccgcgagaaacgatgatcgattactataacatggcagacttgttccttctgccatcttttgaagagttgttcccaatgtcggttttagaagcatttgcaacggatacgccggtaatggtgcgtgatcttgaattgtatcagcaaatcatcacgccttatacaattacggcggtggatgtggcagacatgcaggcacgaattcgggcattagccgatgatcgcgagcttttggcaacatatgcggccaagagccatgaagcggcgcaggtgtacgatgaagctcggcttgaaaaagtctggcatgatttttacgtgcaacaagcagcgttgggtaaacactagccgaggagttatatgacacggaagaacaaactggccgtcttcatcatggttctgattggcgccggcatttttatttatgaagcacgtgatcttaatggtgcaaaactgatccatgaacttttatcgcttgatcttaagtggctgttagtggcttttttactgatgtttggttcatggatcgttgaaaccttcgttgtgcagatttttattaaaaacggatcggacgaattagactttaagacagcgtttcgggttccgcttgtcgagcaactattcaacgcaattacgcccatggcatctggcggtcaaccggctcagctgtttgcactcatgcaaagtggggtggaggctggtcgcgcgagttcggtactgttgatgaagtttgttgtgtatcagtttatggtcctgattaactttgtactcactttacttatcggctttgatcaagtgtctcggcattttggggcccttgcgatcttcatcgtctttggctttgttatccacgtgatcgtgattgtcggcttgctcatggtgatgtactactacaaattcaccaagaagctcgtcagaatcatcatgataccagtcggctggttcgtgaagccagaaaagaagatggcgatgcagcttgatctggatcacaaaatcgatactttttacgccgagagcctgcacttaaagcgcgaaaaagtccgtgtaattaaggcgtgctttttgacgttaattcagttgctgctttactacgcggttccgtattttgtgctattggcactgggtgtgaatcacgttagcattgttgaagtgattgtgttacacgtgatgattgtgatgattgtcagtctgtttccaattccgggtggagctggcggtgcagagtatagttttaaaaccctgtttgcgacgtatgtggcctcaccatctaagttagtgcttggcatgttgttatggcgctttttaacttattatctaggaatgatctgcggcattgttgcaatggcattacctccaaaaaaagacgcgtaaacacccttcagccagtcagcttggttcaaggttttctggcggatggatggcaagctgaaattaaattaaatgggatcccggagacagttacttatgtcttcaggatcccatttttaattgatgatgattcaaaacgcgtgcggattctttccgtttacgcttgattagccgatgtggctggccatgaacgcgcgcaatcgcttaacggcttcttgaagatcggtcattgatgccgcgtaactgattcggatataaccttcgccgccggggccaaaagcggtacctgaaatcagagctaacttctgttcatgtgccaaggcgtgcgtaaattcgcgtgagcttagatgcagttgggtcggaatttttgcaaaaagataaaaggcaccatcaggacgagccacgctaaagcccatgtcgatgagggcggcataaacaaaatcacggcgtttaacgtaagctgctttcatcacctgagcatcgtctgcaccgttcgtcagagcttcaataccagcgcgctgggcaatggtcgttgcggcagtcacaagatattggtgcacctttttggcttgcgcgattaactgctggggacccatcaaaaagccgattcgccagccggtcattgcatgtgatttagacagaccgttgacaataaatgtacgatcgtaggcaaattgtcccatggaaacatgcggctcaccataagtcagttcagaataaatttcgtcacagataatgtagaggttatgtttagcggcgatgtccgcaatggctttaacttctgccgcccgatacgtgacaccggtgggattacttggatagttaaggataatgcctttgattttagcgtcaggatttgcagtgatggtggcctcaatgagttcgggggtcaagacaaagtcggttttactcgtatccatataaagcggcgtaacgtgattcagcgtcagaagcggaatgtagcccggataaattggtgacggaaccagcatggcatcacccggatcactgatcgtcgtaatggcggttgccagtgcttcagtggccccgactgtcaccagaatttcatctgtagcccgatagtcagtggcatatttcgttttaaaaaaatgttgtgcggcttcgcgtaactccggatcaccaaccatcccggtataatgcgagtaattttcctgaatggctttgatcccggcttgcttaacatgttccggggtgttgaaatcaggttcgcctagcgtcagtttcaaaataccgggaatatcactgacactttcgtcaaattgtcgaatctcactaacctcgatggcaggtagttgttcgtttaaaggttgcaatgtcatacaaatctccttaataaagtaagcgcgagccaaacccgatttctgggcaggagagcgcattatgatgtaaacgcgaaccgatgcagttagaagtcggagttagacggctacaactaaaagattgcctaactgacttttacgctggcaaacgcgttataatagcatgcaaatagcatagtccatttgcctatcgacacgcaacgtcataaaagtagaattcaaagtgatatttctcccacagaggcgacggtttatgctaagctatttcttgaaataggaaaaattaggaggccattttatgaaacaatcacagctcgtggccatcatcaagcgccttgaagccatgcaggcaggcgatggcgaggcacagtcacgccgcttcgaaaaaaatggtgatgaaaagggcctcgtgacgtacgatcccaagaccgaaacttacgaacttgaagaattaggcactcaccagacgttccagtttgataatatcgatcttgcggccatggaaatctatgatctaatggattttgatgaagacgagggcactaacggtactgatagtagcgatcaggctcaagcttgagttctgagtaaagcggacttgcgaaggttcgctttttctgtgtgaatcttttctgatttgaaggatcagtagtatgaaatttgactgatgttgagttaaatggcggttgacgcgcaccgccttgctcaaacgcattcaaatgtaggctattgataggctgttgagtagatacctgtatcagtttcaacaagctcgagagaaagactgccacattgcgaatggccgaattgaactgaaaagcgttaggccgtgtttgtcactaaaatgacatcgcggctttttagtaagcgcgagccggcgcggttagagaccggagtgtaagcggcctcgagcgtgatggccggtctttggccattgcgcttgaggtccttacatgcaggtctctgcgccggggagcgcgttaggagataggcggtttacaaaggatcaattttaaaccgttgaaaagatttaaacacttggcaacgagccactaacttgaatgacgtggttttaaggcttctttaagattgcgcttgatccgactgtaatcggcattgaaagtttgtcttttaaggaatgagcggttatcctagcgaatgtgctatacttttgacattaaacaatgacttggaggctccacatgaaccagatcggcgctaaaattcgaggatttttcaataccagactcggttttctggtacttgccattgtcttattctgggcaaaaacttattgggcatatcaagctaaattcaacttaggggtcactggtagctttcagcatttaattctggcagttaatccgattccgacaacgctttttctttttggaattgctttatatatgtcgggacgtaaatcgtatgtcacgatgctgattatcgatgccctgacgtcggtttggctttttgctaatgtactttattatcgggaattttccgactttctgacttttgctttaatcaaaggatcaggtgcggtttccaataacttgaacaagggaattatggggatcgttcagccgacagactttcttgtgtttgtcgatgttctatttttgattttactgttagctttcaaggttattcggatggatatccgcccgatcaaaaagcggtttgcactgggagtttcgttgctggccgtgttaatgtttggggcgaatctggctatggcttatagcgatcgttccggactgttgacgcgcacgtttgacaataactacattgtgaaatatctgggtctcaatgcctatactgttgttgacggggtcaaaactgccagcaatagtgcaacgaaggcaaacgctgattcaagtgatgtcaaatccgtactgaattatctcaataagaatcgcgttaccccgaacgcagaatataccggtgtggcaaagggtaagaatgtttttgtcatccacttggaaagcctgcagcaatttatgattgacttcaaatgggatgggcaggaagtcactccgaatctcaataagctttatcatgaatcagacacactatcttttgacaacttctttaaccaagttggtcaagggaaaacggctgatgcggaaatgatgatggaaaattcattgtttgggttgcctgaaggggcggccatggtaactgacgggacgacgaacactttccaggcggcaccagcaatcttagatcaacagggttacacaaccgcttcgttccacggggatgtaccaagtttctggaaccgtgataatacctataagtcttggggatacgactatttcttttctaagagttacttctcaagtgggaaaaattatgatgtcggctatgggttgaaggacaagattttcctgaaagattcagcgcagtacattgaacaactgccgcagccgttttatgccaaaatgattacggtcacgaatcactatccttacacactggacaaggaaaatcagaccatcagtaagaccgacactggcgatgataccgttgatggttatgtccagacagcccgttatctcgatgaagcaattggtgaattctttgactggctgaaggaaaccggactgtacgataagtcaatgattgttctctacggtgatcattatgggatttcaaacaaccataaaaaagccatggccaagttaaccaacattaccggttttaatgactatgacaatgccatgtatcaacgcgtaccatttatgattcacatgccaggactaaaaggcggcattaatcacacatatggcggtgaaattgatgccttgccgacaatattgaacctgttaggtattaaggacaatgatacggttcagtttggttcagatttgctctccgctaatcatccgcaaacagttgcgttcagaaatggtgatttcgtcacacctgatttcactaaggtaggcagtcaatactttaataccagcacagggaagaaaattaccaagctatccccaagccaaaagaaaacggttgacgctgctactaaccgtgtgacaacggaactgtccttatctgatcgcgttatcaatggtgatctgcttaggttctacacgccaagcggatttaagaaggtcgatcgtagcgacttttcgtataagctaacggatacgaaaaagaagctcaaagccgcacagaagaaaggtacaagcttgaaagcagaaaataagggtaaatcggtggcaaatgaatataagaccgatgcgccagagcttaaaagcgatgatgacgaaagtagtagcgaatccaaataagcgactaaagcttttcgacagtgtctttttaggcactgtttttttggactgatatgaagctaaatttaagcgataattggtaacacatgcatttagtgtacttttgaattttgaaattttctaaacatttgtaagtgaaaaggttgtgctaaattagaaaaaagcgtacaattttactagatgataatagttacaaattaggaggctgacgatgaatcaggcagtttataacaaaacaattaacttgctcaaagcaaagcagattcgggtcaccccgcagcgcgaggcgatcatttcctatatgatcgacagtacggcacacccgacagctgaaatgatttatgcaaaactatcgccacagtttccacatatgagtgtcgcaaccgtatacaacaatttacgtctactggtggatcttaatttagttgaggaaatgtcgtctaatgatgcggcgactcattttgatttcccgattgagccacactaccatgcgatttgtaccaactgcggtaagatttttgacttcacttacccaggggtcacggatgtggaggcagtggcagctaaaaaaaccggtttcaaagtcagtgggcatcatctcgaggtttacggtatttgtcccgagtgtcagattaaactgggtatgaaataagcctacgttactgttcggatggccacgctttaaaatgagattttatttggatgcagctatcaagcataattgatggctgtttttatttggcgatagacgctgcaaaggataagtcaccgcaatatctaacgtgcaatgatcctgtgctttgagcaacgtcaatcaagcaagacttttttgaaaaaatgcttgcgcctcaaccggcttgctggtattatattattgctgtcaaaaagcagatccctttttggggtaaagataaaaatagtcatgaataaaacatatgaagcgtttttaacaaaaaatgttgacatgatatgctgatcatgataatctatcaaagttgtcttttgacaaagtagtcctttgaaaactgaacaaagtttcgtttaaatgtgcagggtccttgatacttcggtatcgaggcaaaaagtaacatttgcgaagtcaattcgctagaacaacaaatcgagctattcaaacagctcatatttatatgagagtttgatcctggctcaggatgaacgctggcggcgtgcctaatacatgcaagtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactggaaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcgggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaaacagactgaaagtctgacggaaacctgcacacacgaaactttgtttagttttgaggggattaccctcaagcaccctagcgggtgcgactttgttctttgaaaactggatatcattgttgtaaatgttttaaattgccgagaacacagcgtatttgtatgagtttctaataatagaaattcgcatcgcataaccgctgacgcaagtcagtacaggttaagttacaaagggcgcacggtggatgccttggcactaggagccgatgaaggacggaactaataccgatatgcttcggggagctataagtaagctttgatccggagatttccgaatgggggaacccagtacacatcagtgtattgcctgcaagtgaatacatagcttgttggcggcagacgcggggaactgaaacatctcagtacccgcaggaagagaaagaaaactcgattcccatagtagcggcgagcgaagtgggaagagcccaaaccgagaagcttgcttctcggggttgtaggactggacattggagttaccaaagttcgacgtagtcgaagtcagctggaaagctgcgccatagaaggtgaaagccctgtaaacgaaacggcggactctccgtccaggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaacagttcctgaaaccgtgtgcctacaattagtcaaagcccgttaacgggtaatggcgtgccttttgtagaatgaaccggcgagttacgtttgcctgcgaggttaagatgaaaagtcggagccggagcgaaagcgagtctgaacagggcgcttcagtaggtagatgtagacccgaaaccaagtgacctacccatgaccaggttgaaggtgtggtgaaacacactggaggaccgaacccatgtatgttgaaaaatgctgggatgagttgtgggtagcggtgaaattccaaacgaacttggagatagctggttctctccgaaatagctttagggttagcctcggaggatggatcatggaggtagagcactgtttgaactaggggcccgtcaagggttactgaattcagataaactccgaataccattgatcttactccgggagtcagacagtgagcgataaggtccattgtcgaaaggggaacagcccagatcaccagttaaggtccctaaatttatgctaagtggaaaaggatgtggcgttgcacagacaactaggatgttggctcagaagcagccaccatttaaagagtgcgtaatagctcactagtcgagtggcactgcgccgaaaatataccggggctaagcataataccgaaactgtgggtgcacccgtcagggtgcgcggtaggagagcgttctaagggcgttgaaggtcgatcgtgaggacggctggagcgcttagaagtgagaatgccggcatgagtagcgaaagatcagtgagaatctgatccaccgtatgactaaggtttcctggggaaggctcgtcctcccagggttagtcgggatctaaggcgaggccgcaaggcgtagtcgatgacaagcaggttgagattcctgcactagtttattttgtttaagcgatggagggacgcaggaggctaaggaaagcgcacggctggaaaagtgcgtccaagcagtaagtccggtggcgagtgaaatgcttgccgccttaaggacaagctgtgatggggagcgaaattaaagtagcgaagttcctgatgtcacactgccaagaaaagcttctagtgagaaataaactacccgtaccgcaaaccgacacaggtagtcgaggagagtatcctcaggtgagcgagcgaactctcgttaaggaactcggcaaaatgaccccgtaacttcggaagaaggggtgctgaccgcaaggtcagccgcagtgaataggcccaaacaactgtttatcaaaaacacaggtctctgctaaatcgtaagatgatgtataggggctgacgcctgcccggtgctggaaggttaagaggatgagttagcgcaagcgaagcccagaattgaagccccagtaaacggcggccgtaactataacggtcctaaggtagcgaaattccttgtcgggtaagttccgacccgcacgaaaggcgtaatgatttgggcactgtctcaacgagagactcggtgaaattatagtacccgtgaagatgcgggttacccgcgacaggacggaaagaccccatggagctttactgtagcttgatattgagtgttggtaccgcttgtacaggataggtaggagccgtagagatcggaacgctagtttcgatggaggcattggtgggatactaccctagctgtatgaacactctaacccgcgccactaatcgtggcgggagacagtgtcaggtaggcagtttgactggggcggtcgcctcctaaaatgtaacggaggcgcccaaaggttccctcagaatggttggaaatcattcgcagagtgtaaaggtagaagggagcttgactgcgagactgacaagtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgttccgctggtgtaccagttgtgccgccaggcgcatcgctgggtagctatgaacggaagggataaacgctgaaagcatctaagtgtgaagcccccctcgagatgagatttcccattcctatatggaagtaagacccctgaaagatgatcaggtagataggctggaagtggaagtgcagcgatgcatggagcggaccagtactaatcggtcgaggacttaaccaagtaaagcgcaaactggcgctaagccagcgcgcgcgtttcgatgaaatacgttaagttccggcaatgtaaaccaacaacaatgatagccagttttgagagcgcaaagttctcataagtgtggtggcgatagcaagaaggatacacctgttcccatgccgaacacagaagttaagcttcttcacgccgagagtagttggtgggaaactgcctgcgagggtaggaagctgccacgctgtttattccggtttagctcagttggtagagcacctgactgttaatcaggttgtcgtcagttcgagcctgacaaccggagttttttatggagagttgtccgagaggctgaaggagcatggttggaaaccatgtatacgggttttgcctgtatcaagggttcgaatcccttactctccgttttattgtctctagttgctttccatagcttcccaaaacgctgatatgatagtgttttgggatttttattttcttttgtttttggatgttttaaaaattttgagaccaaaagcctatgctacaaaagtaaaattgacgctaatttttatttgtaataaatgtttaaagtacttgccattcttggctgtctccggtagtcttgtacaagtagtaatcgtcatggaggattagctcagttgggagagcgtctgccttacaagcagagggtcacaggttcgagccctgtatcctccatcagtttacgtccgctgtcattgcgggcgtttttttgaattgttaagctaattcaacgtctaaactttgattgtgatatcgtgaaagttaaaaaaatcctccctaaactgttgaattaagggaggagatttagtgttgacggtgatgtttatgctaaccatgcatgcgtgctaagtagagtagaagggtcatgattaatgggctgaattgataaatgtaacgaggcaatttaaagggacgtcgactgttaatgacggtgacaatgatgaacatgccgccaatggcaatgaagtttattcgttgctgtacatagccaaggatggcaacaaccagtaggagaatcagatcggtccacttaggaaaacggttggcccaaagcccgatcagcgcaggtaaatagagaagcgctaggtctagcagcatggtgcgattgaagaaatgcaggctggcatagattagcgtaatttgaagtagcagggcctgaccaaaaacgacagtgtcaacccagagcgcaggcattttttgcgtctgtaaaagaaacgcaatgacgatttgaacaataatgagtggcagtagcagccattgattgattgtgccgatgataccgctaacgcctgctatgagcagtaggagcataagcttgtttgaactgacgagtgttgttccagcaagacatgttgtcataaacagtaatgcgacaagttgaaaagtccagttgacttgcagcgccatagcaattaaaaatgggtaagcaagtgcctggcctaagaatgcgattgcgtaggcgctttgatcgatttttttcaagatggatgtcctttctatatagcctcattttacaaaaccacgttgccagagacaaagattttcggaatttttatattttttatgttatgctactagagttgcaatacattcccgatggggttcgttagcgattaacgaacatgccttgtaaccgaaaatcatgagggggaaacaaacgatgcaagaacgccatttatttacttctgagtctgtatcagaaggacatccggataaaattgctgatcaaatcagtgatgccattctggatgcaatgctcgaaaaagatccgaattctcgagttgcgtgtgaaacaactgtgacgacgggattggtgttggtggtcggcgagatttcgaccaatgcttatgttgacattcagtccgttgttcgtggcacgattaagaaaattggttatacaaaagagtctgggtttgatccggatagtgtcggtgttttggttgcacttgatgaacagagcccggatatcgctcaaggtgtggatgaaagtcttgaggcccgcgattccgataccgatccgttagataaaatcggtgccggtgatcaagggatgatgtttgggtttgccattgacgaaaccgacacctatatgccattaccgatttcgttggctcatgccttaatgcgtcaaacggataaattgcggcacgctggcgaaatcagttatctgcgcccagacgcaaaggcccaggtaacagtagagtatgatgataacgagcagcctgttcgggttgatacagtagttctttctgttcagcatgatcctgacgtcacactggaagaaattcggcgtgacgtagaggctaaaatcattcggaagatcattccagctgacatgatggatgatgacacgaagatttatgttaacccgaccggtcgctttgtcttaggtggtccgcaagccgattccggattgactggtcgtaagattattgttgatacttacggtgggtttgcccggcatggcggtggggccttttccggtaaggatgcgacgaaggttgaccgctctgctagttatgcagcgcgttatattgctaaaaatattgttgcagccggcttggccaaacgcgtggaagtgcaactggcttatgcgattggcgttgctaaaccggtgtcggtatctgtcaacacatttggcaccaacgttatttctgaacaagtaattgaacaggctattcgcgagaactttgatttgcgcccagctggtattattaaaatgttagatcttaagcggccgatttatgaacaaacagcggcttatggtcattttggacgtacagatgttgatcttccttgggagcacttagataaggtgcaagcacttctcaagtatcgagattagcgagaaaagaggcggccttggacgggcgtattcccatccgggtcgtttttttatgctttggtggtgtgagattagcactggcatcgcgctggctcgcgctcacattttttaaggagtaatttatgaagcagagaaaaacaaatgttgctgttgtgacggcggcaatttttatgggtacttttatgaccgccatcgaggggacgattgtctcaactgcgatgccgacgattattggtagtttacatggcgtgcatcttatgaattgggttttttcaatttttcttttgactaatgcgatggcaacgccgatttatgggaaattaagtgacaaaattggccgtaaaccggttttcttgattgggctgactgtttttgtcatcggttctttgttatcgggtttgtcgcagtcgatggtgatgctgatcgtctttcgcgcgattcaaggggtcggtgctggtgccattatgccggtgacgtttaccatcgttgccgatatttatccgtttgaaaagcgggctaaaatgctggggtttaatggttcgatgtgggggattgcatctgtcattgctccgttactgggtggcttcatcgtggatcaattgagctggcattggatcttctttattaatgtgccactcggattaatcacttttggccttgtttggttctttttgcaagaagatcggcgtcaggtacggcaaccgttggatatgcgcggtacggtctggcttttggttgcgttgttagcactgatgtacggattccagacgcttgctgaacccaatgcgatttggcagttagcggggatggcacttattgccgttgttggcttttggcgtttttggcaggcagagcggcgggcagttgatccgattattgatctaaaactctttgaaaatcgcacgtttatcattcataacttgattgcggcgttgatttcagggtttgtgattgggtttgaagtttatatgccgatgtggattcaaggcattcttggtatggatgcatcgcttggtggttttgccgtaacgccgagttcgttgatgtgggtggtcggttcgttttttgccggtaagttactgggacgttttcaacctaaaccgattctgacaggggccatgttttggctgcttgggggaagcttggtcttagcgttggtgccacagtcaacgccgtattttgttttcctactggttgctggctgtcttggcttgggatttggcttggtcattacgatcacaacggttacagctcaggcggtggtcagccctgatcaagtgggtgtggcgacgagttttaatacgttatcgcggacgctggggcaaactttgatggtttccgtttatgggatcgtgcttaacttgcggctgactcaaggcgtggcggctgatggccggctaaacagtaatatgttaaacgaactgatcaatccgcatacggcaaaacagttaccggctagcgttttgccaacgttacgtcaaatcctttatgaggggctgcacaatatttacttcttttcaattgtgattgtggcgctcgctttggtggccaatcattttgaagccaaaaaggttttagcaaaagcggccgcgcaagaatctgatgaagaagcttgaactatgaagccggtagttacggtagccattcgtttgagccaaagtttttctaatcaagccgttgtattattgagcggacgggcataaaaaaatcggccttagagaacgtcaattcgtttctctaaggccgattttgcatagcagcgttcatcatcaagcgcgaaaagaggtatcaatcatttcagcaggttatcggtcgtttgctgattgatcgcggcggacggtttaatcggctgtttatataatttagcatttttttcatttacgacggccacgacatcatatgtggggtcattttcaaggggcccaaaatttagcaaggtttgctggtcatcgtattgaatgtcttgaaggcgggtactcatgaggacatgaagcatgtcggctttttgatgcgactttttgatttcttcactggctttagctaaggtataaccttcatccagcatggttttgatcatgacaattaacgcaatattggacagcgaataacgtttgttgccatttgcttcgtggcgacgtgaatgaatcaggtgctttttttcccaataacgaatttgggtaggggttgcaccggtgatacgacttgtttcgccgatgcctagtgaaatatcgagtgatcgcaaccgcttattaaacagttccatgaaaatctctcctctgatgagcgtgcgccgggaagcacgttatggtgagcgtgaaccagacgaattttgctaaacctgaacccgctgcctttaaaaaatatgcagcgactttcaaatcacaaccttgacaactagttagtttaaatgtaatataatctcctgtcaatattacattatgtaatattaaaagtatgaaacattataaagaaatcaggcgaagttatggacgttaaagatatcaacgggaaacctgtgaacgtaccgatgatggtgattaccctcattgtcgggacattcatcacggttcttaatcagacaattctctccaccgcgtttccaacgttgatgaaggcttttgatatttcaaccgcaaccgtccagtggttgtcaacgggattcatgctggtaaacggtattatgattcccgtttcggcttatttaagcgcaaaagtcccatcaaaatggctctatatgagtgccatgagtactttctttgttggcacgctggtggcgtttgttgctaatagttttggcgtcttattagccggacgattgattcaggcgatcggcgtcggaattaccatgccgctgttacaaaacatcatgatgtcgattttcccaccaaatcggcgtggagctgctatgggaatggcggggatcgcgattggggtggcgcctgcaatcgggccgacactttccggctatgtcatcgataatttcggctggcgggttttgttcggcatgatcctgccaatcgcggcgttggtgattcttgcggccatgttctttttcaaaaacgtgttaccactttcgaatccgaagctggatgtgccgtcgctgattgagtcgtcaattggatttggcgctttgttgtacggcttttctgaagtcggtaatgacggctggggcgatccaatggtccttggttccattgctgtcggactcatcttcattgtcatctttgggtatcggcagttgcatcttaaggagccgtttgtcgaattaagagttttcaagagtaagatttttgcgttatcgactgctttagggacgattgccaacatggcgatggtcggcgttgaaatgattttgccactgtatctgcagatcattcatggtaaaagtgccttggaatcaggactaacgctgttgccaggggcgcttttaattgccgtgatgagtcccgttaccggtcaggtttttgatcgcattggggcaaaacgcttagctcagttaggtctcttcttcctgacgattgcaacgttgccgtatttcttcttaacgacgaatacgccgtcaatcttcattaccgtgatttatgcggtgcggatgtttgggatttcgatggtgatgatgccattgaccaccaacgggatgaatgcactgacacctgatatgattcggcatggtaccgcggtgaataacacggtacgtcaggttgcgacttccatgacaacggcggttttgatttccgtgttgtcaaatgttaccaacctcgccaagccggctgccagcttgttgaagcgcaatcctttgcagtataagcaggacttcctcaatgcaacattaaacggttaccacgcagcctttttattagcagttggctttagcttggttggctgggtgcttgcattcttcctgaatagccacgccatgtcacaggaaatcacgattcaaccagaaaagaaggtgaaggcatgattctttggttcttaggtctaatggtcattggcctttatctcagtttcatcatgatgcatcgatcggcaaagcggagcacgttaattgccattttcagtattggcttgatgggcagtctgttactgatggtgcttaacgataacgcccattttggaatggaaaaacgaacgactacggatgaacaaacgatttatacggcatcacccaatgcgcagatgccaatgttattgaagcaaaatgttggcactgccggtaagcatgttgtctacatctataaaactgatcctaagaaaaaagcggtgcataccaaagcagatctggccgtcagcaatcaggttgtgcagacgacaggaacaacggcttcgatgacaagtcgcacaactcgctgggaatatcaaaatagctttttcagtgcattgtttaaccaccaaggtgcaggccaattggtggcacagcataatcgactcgtggtgcctaaaagttgggttgagctgacgacgacgcaagccaaacgtctcggcactaagctcaaagccttgcaacacccgactgctcagcaaaaagcaaccatggctgccgcggtgaaagccaaagctgctgagttggctcaagcaaatccgaaactggcgagcgatcaggcggcactgttgaaacaagcacaagcagcggttcaacaagcaatgattcaacaggcggttaaagaagttcaacaacaaaaataaccggtccgagttaatgttgatgacgatgcgacaatcaaaaagcagatatcagccgttaaagctggtatctgcttttttcatggcgctgatgacggcgggagaaatacgggctaaagtaccaccagctgagcattaataaggcaaacccgagcgcaaagcctgcgaagacatcggttggataatgaacccgcacaaaaattcgcgaataaccggtcaatccaatcatgccgccagccaacaaagtaatcatccatttaatcgttggtcgcctgacaaaagtccatgctaaaagaatcaaggttccataaaacatcatcgtgccgcttgaatgaccactcggaaaactgaacccgccagcctgtaccaaagcgcgaatttgcgggtcggcgatgaatggacgcggtcgctggactagatatttaataccaatatttaaaatccccatcatggcaccgacactagccgtaaacaaagcggcgatccgataacgatagatcaaaagcacccctgctaacccgagcgttaaaaaaatcagaatgctcggattgccgagttcggtaacggcgatgaggattggctttagcgcatccacatggaaccgggtcacaaatgcgatgacatgctgatcagtcgtttgaatccagcttgcccgattgagaatgccaattaagaaaataatgaagatcataaaagcagtacctgaaaaataaagtggcaatgaccgacgatgcaacaagacaacctcctgtaaacgtaaattgataaccgactgaataccgtttagtcggcttttggtcaatccacggtgacgcgttgacgtttccgcagattgacaaagaaaataactaatatgactagaatagcataaagaccattgaacactttcatggtttttgctatgattgacgcaatcatcaaacgaacaaaggagtagtaagtcggcgcgggtttcagagagcaggcggtggtgcgagcctgacgatgctaagactgaactgacctttgaagttgctgcggtgaacggagtaatcgcagccggccggaccgttaccccttttgagcgctgtgaaagcagaacttaggtggtaccgcggctgagccgtcctaatgaagactagggcggctttttgtttgaaaataagtgggaggtaacaaaatggcatacgatcatcatgagatcgataagaagtggcagcgttattgggccgaacataacgaattcaataccacgaccgatccgaagaaaccgaattattatgcattagacatgttcccatatccatcaggccagggcttgcatgttggacatccagaaggctacaccgcaaccgatattgtggcgcggatgaaacgaatgcaaggatttaacgttttgcatccgatggggtgggatgcattcggtttaccagctgagcaatatgccttgaataccggtcacaatccccggacttttactaagcaaaacattgaaacgtttaagcgtcaaattaatagccttggtttttcatatgattggaaccgggaaattaatacgaccgatccgaattactacaaatggacacaatggatttttgaacaactgtataaacatggactagcgtatgaagctgaagttccggttaactggagccctgatttgggaaccgtagtcgctaacgaagaagtgatcgatggtaaaacggagcggggcggttttccggttgttcgtaagccgatgcggcaatggatgctaaagatcacagcgtacgccgataaattacttgcagacttggatgatttggattggcctgaatcaatcaagcagatgcaacgaaactggatcggcaagtcaaccggggcgcaaatcacgtttacggtcaccgatacccaggaaaagtttgacgttttcacaacgcgtccggacaccctttttggcgcaacttatgtcgtcatggcaccagagcacgacttggttgaaaagattacgacgccggaacagcaggcagttgttgatgcttatattgaagaagcagcacataagtccgatcttgaccggacggcgctcgataaggaaaaaaccggcgtctggacgggtgcttatgcgaccaaccccgtcaatggcgagaagttgccgatctggatttcagattatgtactggcaacttatggtaccggggcaattatggcggtgccggcccacgatgatcgcgactatgcttttgctaagaagtttggcatcgaaatcaaaccggtcattgaaggtggcaacattgacgaggcagcttataccggcgatggcgtgcacattaattccggctttcttgatggcttaaacgaacaggatgccattgatcggatgatcgcatggctggaagataaaggcattggccaggcaaaagttaactataagttgcgtgactgggtcttttcccggcaacgttattggggcgaaccgattccagtgattcattgggaagatggcgagacaaccctggtaccagaagatgaattgccgctgactttgccggaagaagttgatatcaagccaagcggaaccggtgagagcccgctcgccaatttgacagactgggtcaatgttgtggacaagaatggccgtaaaggtaagcgggagacgaacaccatgccgcaatgggccggttcttcgtggtacttcctgcgctttgtcgatccacataacaaagaggccttggctgattatgacaagctcaagcagtggatgccagtggacctttatatcggcggggccgaacatgccgtgctgcatctgctgtacgcgcgtttttggaatctgttcctttatgatatcggtgcgattccaaacaaggaaccattccagcgcctgtttaaccaaggcatgatcttgggtgataatcatgaaaagatgagtaagtctaaggggaatgttgttaaccccgatgacgtggtggacgaatacggtgccgatactttgcgcctgtatgaaatgttcatgggaccgttggatgccggtatcgcttggtccacagatggtttggcgggtgcccgcaagttcttggatcgggtatggagtgcctttattgatgatgaaggtaaactgcgcgatcgtatcaccaccattaatgacggtcgtttggataaggtctacaacgaaacggttaaaaaagtaaccgaggactatgaggcgttgcattttaacacggcgattgcccaaatgatggtcttcatcaattcggcgcgcaaagacgatgatttgccgctagaatatgttgaaggctttgtcaaaatgctcgcaccgatcgcaccgcacttgatggaagaaatctggcaacggctgggacatgatcacagcttaacctatgcgccgtggccaagttatgatgaaagcaagcttaaaaccgacacctacgacatgatggtgcaggtcaatggcaaacttcgtggttccatcactgcgagcgttgacgagactgatgacgagatcaaacaagctgctttagccaatgaaaatgtccagaagtatacgacaggcaaggatattaaaaaaatcattgtcgtaccacgtaagattattaatatcgttgctaagtaatgtggttgcattttggtcagactgataggataagtttgattgccacaattgcggttctagagacaaaaactgcctctggaatcgcttttttggtgagcgcgagccggcgcggttagaaagtaagcgtgagcaagcccgcttagaagccggagtgtaagtggccttgggcgtgatggccggtctttggccattgcgaccaaggtccttacacgcaggcttctgggctggcaagcgcgttatgggcgtaaaccagaatataagcggcctcaggcgtgatggccggtctttggccattgcgcctgaggtccttacacgcagatttctgggctggtgaacgcgttatggtgagcgtaaaaagctggacagtatcggtcgggcagaagagcatcttcccaattttatgacttttatcagctagtaaaagtgtcaaattcatcttgtgaagacatcgggttcatgacgcaacgtgtccattatgtgaaggcaatggttcagctcacgtgaccacgattttcaaagatttcttttgattcaacaaagaaactcagtaaagattgcaagtgaggctgggattgcctaaaatataaaggattacgcaacacgacaggagcttatcatggaaaattcgctgggcggcgggacgcaaccgccacgttcagacaaggaaaaaatgatccgcggttcggcgtggatgactgccggcagtgttttttcgcggattcttggtgctatttatgtcattccgtggcgtatttggcttggagcggcttttttaacggctaatgctttatttactaaaggctatcagatttacagcctgtttttgattatttcaactgctggtgtgcctggagcggtttccaaacaagttgcccgctataatgcgatgggtgaatataaaaccggtatgcggctcttttatcacgggacatttgccatgttcattatggggattctgtcttgtggggcaatgtggttgctagcgccattgctcgcagcaggggatgcccggatgattccggttttccgctcgttggcatggccactgttgctgattccatcgttgagcctgattcggggctttttccaaggctataacgaaatggcgcctagtgcgatcagtcagtttattgaacaggttgcccgtattctgtatatgcttgtcatgacttatgccatcatggttgccggtaaccatgattacctgaatgcggttgtgcattcaacctttgcggcattcattggggcagtttttggacttggcttattggtcgtgtattttgttcggcagaaaccgcgattggatactttggtggcacaaagtaaacaggcgctcaatatcagcgttaacgaaattttagttgatgttgcgcggcaggcgattccgttcattatcatggattcaacgattaatatttactatattgttgatcaatacacgtttaatccaatgatgaaggcgttctacttagttagcgaagatcagcttgatcggttctatgcattatttgccggcaacgccaacaagctgatcatgatcattgtcagtcttgcagtggccatggcaattacggttgttcctttgctggctggcgcaaaaacgcgtggggatgttgaaggtttagcacggcaaattacgaacacgttgcagcttttcttcatcgtcatgattccatcggcgttaggcatggtggccgttgcgcgtccgttatatgttttgttttatcgtgatatggacttccttgggattcgcttgttacaattttcgtcaattttggcgattctcctaggattatttacggtgttggccgctattcttcaagggttgtttaataatcgattggcgattcaggagatgctggttggtctcgctgttaaagtcattgcgcaatggccgatgatcttcttctttaatgtttatgggccggtgatggcgacaatgttgggcatgacggtgtctagtttgttgatgttgtattcgactaatcggatgtacaatattcatgtcagacagaccattcggcgcggcgtcggtattttagctttttccctgattatgtgtgcggtttgctacttgatcgtggacgtatccggtattctcattaaccctgagagtcagtttggcgcagcgtttgttttactggtagcagttggttttggcgttttgatttacggttatttgattttgaaaacacgtttggccgatatgatcattggtgcacgggtcagtcggctgcgcgaaattttacacatccggtgattttatgcgattagataaatatttaagtcatttacagtttggtagtcgaaaagaagtcaaagccctgattcgcgacaagcgcgttcggattgccggtgagttagtgacggatccgggctacaatattcttccgggtgttgccgttgaggttaatgatgctcaagcagacgggccacttgaagtcgattatttaatgaacaaaccggctggcgtcatcaccgcaaccgaagatccaacgcaatcaacggtattggacttgattcgaccacatgattatcggcccggcctttatccagtcgggcgccttgataaagatacaactggactgttattgctcacaactgacggcaacttagggcatactttgttagcgccaaaccaccatgtaccaaaaacttatgctgctaagttagccaaggcacttacaactgagatgaaacaccagttagaacaaggcgttgctttaaaagactttacgacggcaccagctgacgttcaggttgtaccggcgactgacaataaagaaattcatatcacgattacagaaggcaaatatcaccaaattaagcggatgctgctggccgttgataatgaagtcgtcgcgttgacacgaattgcaatgggaccattacgtctgcctgaggacttagacgccggtgagtatcgggcactgacggatgatgagcgttcgctactggatcagatggtacgctaagtttaatctttactttttcgttaacggatccattgtcagggcatagttgtacccctatactgatagacaagaaagggtgagcgcaatggaccaacaacaatatatttgccccaaatgtcaaaatacaagctatatctcggatcggtttcaggcaacgggcggtaatttctccaaaatctttgatgttcaaaacaaaaagttcgtgacgatttcctgtacccgctgtggttataccgagctatatcgcagtgaaaccagttcggggatgaatgtcttggattttctattaaatggcggttgattttgaccattttgacggtagcgtccgtgaaatatcattaagataaacttggcagaatacataaaaacgtccttagaagcacgaaattctaagggcgttttttggctgtcttgattgacattatttaagttgttaattcgctgatacagataattgtttcagataggctggtagctcgcgaatgaccatggttggtaaggcgacgtagctattcatggccacgatgtctgctacgtgtgagtgaacaaagaccgcggctaacacagcttggctcaaaggatggaattgtcccgcaaaagcagcaatgatgccggttaaggtgtcaccggagccgccagttgccatggctggtccgccagctgtgttggcatagatttcgtgtccgatgaatacatgcgtttgggcacttttggcaatgatgattccagggatttttgcggctgcttgttggctggcttcaattgtttgcgctgcgagtgccaagccggagagacgttgccattcgacttgatgcggtgtccaaattagctgggcttggggataggcgaggtgatgggtggctacaagggtaatggccgagccgtcaataatgagcacttgggtttgactaacggctgcaaagacacgctttaaaattttcaaagcagtcgtgtccgtgcctaatcccggtcccacaacaatgacggtcgcttgatggatcgctgtctccagtgccgaagtggaagcatccagaatcatcgcttcaggtaagcgggcgtgtaaagcgctgcgattgacaggatcggtcgcaacactaaccagtccggcaccggcgtaaacagccgcactggcactcataattgctgcaccaccatattgcgcattaccgccgatgataaggattttaccgaagctgcctttataagtattccgtgatcgcggacgaacaatggcacgcgctaattgttccgtcagttgtttcatggtgtgggcacctcttttaaaaccgtccagtcattaaatgtttgcgtggataaattcggggtgccggtttgcaggtagtctttggcaaacatgacaagtggtgaggcgttttcccaagttaactttgctagcggcagggcacatgcacccagtgagtcttgacctgtaaactgtgggactgacgatgccaactgtccaccggttaacgtcaatgcataaaacacgcaaatatgttgattaatcgtccaacgttcatattgccacggataaacaaagctggttgcccctaactgtcggtcgatcgtggcagttaggccggtttcttcgctaaactccctcaagacatcatgctcaagtggttcgggaccatccaagctgccaccgggaagatcgaatcgatgaatatacggtccgccatttttccgaatgacgatcaagcgctggtcaatggttgcaatgccataacagccaaacgcgcgatgggttttatgtgtcattgtctcgcctccatcatttaagcgtagcacggagagggaggtgagacaatgagtacttggcttgtcccctttttgtccccctgaaaacaaaaacaaagccctcctaagataacctaggagggctaaaacgttgatgtataggcatttcattttctaaagaaggctaaaatatcctatgaaatgccgcgaacaggaatcgaacctgcacgggaataaatcccacagcgacctgaacactgcgcgtctgccagttccgccatcgcggcaacaacaataatgattatagcggatgcgtagaaggggcgcaagcaaaactttaaatatttttccgggttgtccgattcaaaaaatgttaggataaagcaacgtgattatttgagaagggtggtagcatcatgtcaatttacgattttgaagtaacgctagaagacgggtccaagtattcattgaataaatataaaggccggccgatgctgatcgtcaatacggcaaccaaatgtggttttgccccgcagtttgacggtttggaagcattgtataaaaagtatcaaaaagcaggtttgatcgtgttaggatttccatcaaatcagtttaagcaggagctggcggatggacatgctgcagcagaggcatgtcgaatgaagtacggggtcagctttccgatgcatcaactgatcaaggtcaatggtcagcagacggcgccgttgtttaaatatttaaagactgaggctccaggcgaattgggtaagtcgatcaaatggaacttcaccaagtttttggtcgatcgcaatgggcatgtcgtgaagcgctttgcacctaaaacaactcctgaagcaattgagccagcggttgaggagctgttatcctaaggttttaaaaggattgccggatgactgattgggtacttgatgacggtggacatggttctactggatgcgtacaatgacaacaaaagcaagaaagcagggatcattgatggaagatttgccaactgatattgcaacgtttgtggacacgcacttagttgatcgtcataatagcaatgctgtgaagtgggacggtctgaaagaagaatttggccgggctgacttgttgcctatgtggattgccgacactgagtttaaggcgcctcaagcagttttggatgcattgacagctcgcgtcaaggaagggacgtttggctattccattcgcccgcagtcttattacgaagccttcattaactggcaaaaggaacgacatggcattacggttgaacctgagtggatgcgttttggcgttggcgttgtcaaatcactgtatgcgatggtgaactggctgacagaacctggtgatccggtcctcatcatgcagccggtttattatccctttatgaatgccattaatgatcttggacgtaaagtcgtatcagttgacttgcaattaaccgctgatggttggcgcatggattttgaccaattagaaaagaccttggcggcgaatgaaattaaagcgatgattctgtgttcaccgcacaatccggttggtcggatctggacccgagatgagttagaacaactttttgccatcacaagtcggtatgatgtgacagtggtttctgatgaaattcacggtgatcttgaagtgagtgggccgaagtttacatccgctctacaggtcgttgaaggtaaagctcgaaaaaagcttgttgtgctcaatgcgccgtcaaaaacatttaatttagccgccttgctgaattcacacattattattcccgatcaagcgttgcgtacgagttatgatgccttcattaagcagctgcatccggttgatacgagcttgatggggcaagtggccggtgaagctgcttatcggcatggtgctgcttggttagatcaggtcttacaagtggttcgctacaattatcggcaactgcaagctggtttagccgcggcggccccacaagcgaccctggccgatttacaagggacttatttggcttatgttgatattggtgcttatgttgcgccaagtcagatcaaagactttgttgaaggggtgtgcggattggccgttgattatggtgcatggttttcacctcaaacggcaacttatattcgtttaaatttagctactgatcctaagcttgttgccgaggcgattaaccgattaaccactcatttggcacagcagccgcagcggtgatcgggacaagagttaaattgcctttttcaagataaaactcgaattcaaagagacggaatggttctccttgaatccgagttttttaatattgtgctgcacaaaccagtttacttgatatgggacgtgttatcgaagcttgaggcgtaaatactgatcgcctaaattgtgatcctgaacaatggttttcagatatcggcgtaacatggctgaacgttcaagcacggaccaaccggggtcggcatgcaaccgtttaagttcagcgcgacttggatgatcatttccggtgaaaaagcgccaattcaaaatacccattaatctggcagcggcgtcaagatcacgctgattggtcacattattgtccattaaatcaccataggctaacgcttcaccatcttgcagaaataattttttcaagtaacgctgatagtgcaaaagatcaggattttttcgctgttttgcggtgagataaggggtcaggttggtgatctgtttttgataagtaatttgctggggaccaaacgtgacgaccccataactagcgggactaatagaaaacgcaccactgacaatttcgatagtcgggcactggccagctgggtcgtggctgatgtcttgtgcatgaatatgcccggagaagactaagggcacatgatagcgggttaataacttttttaacgcgtcactattgtctaaaacataaccttgattgacggcttcgttatgcgtgtatagattgtgatgcatgaaaataattgacttgcgatgcgcgcgggcacccagcgctaattggcggcgcacccaggtcatcgtttgcggagaaagcttaccacctgtattaggcggacgattagatggctcaatcgtgtaaatgttgctatctagcagtaacaattggtattggtgattgagatttacgcgataacttagactgttcccatcttgggcagcagcttgttcataactgctgtggaagatctggcgccagtcgctggggctaatttgttcagtcaggcgttgttggcgtcccttataagcgcgggcccaaccgtcataaatatcatgattcccggggatgattaacactttaatgccatgggttgtagtcggtgcattaagctttcagcactggttttctcaccgttaaacgtcacatccccagtgatgattaaggcggttggccgtgattttaaggcgttttgcactaatgcatgaatggcaactggttgataatccatatctttacccgcggctgatcgtttgatttgggtataggcgctgcgttcatcgtgcaagctaggcgcaataaaatgcgtatcactaagcacccagatgcgtggatgggcatcgtcagttaacggcgtttgatgatcagggtggacttgggttaaccctaatgcgagcaggaacataccaaacagtgctaccaaatatttaccgactttcattttctgcctccaaagttaattctaccatgataaaagaccggcgctagattgacttatttaggtataagcattaattgccggatgcgaatttgggagtgggggactgcgggcagttgttgaaaatcttcgcagcttacttcatcggttatggtaaaataaagcatcgtttcaccgtatgaaccaaaataattgtttttaaagagaggaaagaagcatgcaagtcatcgtaaccgttattgggacagataaggtcgggatcatagcgcaggttaccactgcactcgctaatttagatgttaatatcttagatgtgtcacaaaccattatgcaaggcgcctttaccatgatgctattggctaaaattccggatgatgccagtttcaaaactgttaagcaaaaactaacagctttaggcgacaaaatcggtgtggagatcaaagtttcccgtcaggagatttttgacgcgatgcaccgtctgtaagctggtttagtcataacgcgttcgccggcacagaagtctgcgtgtaaggaccttaagcgcaatggccaagagcgggccatcacgcttaaggccgcttacactccgacttctaagcgcgccggctcacgctcacattaacgcgttcgccagcgcagaaacctgcgtgtaaggacctgggtcgcaatggcaaagtgcagccatcacgccccaggccgcttacactccggtttctcccgcgctggctcgcgctcactataaaggagtagcttgatcatggagacgcaacaaattaaagaaacaattgaaatgatcagtgaggaaaatctggatattagaacgataaccatggggatttccttgctggattgtgtgacgggtaatttacaaacaaccgctgatcatgtttacgctaagattatgaaaaaggcggccaatttggtagcggtggcggattccattagtgatgagtatggcattccgattgtgaataagcggatcagtgtgaccccggttagtcttttagctggggcggatcaaatgcttgattttcggccggttgcctatgcgatggatcgtgccgctaaggatctgggcgtagatttaatcggtgggtattcggcattagtccaaaatggcagtaccaaggccgaaaccgcgctgatgaagagtttgccggaagtgttagcaacgacagaacgggtctgcgcttcggtaaatattggcagtactcgtagtgggttgaacatggacgccgttaagttgatgggaacggtggtcaaacaggtggctgatcggaagccgcaaaatgccatgaaactggtcgttttttgcaatgcggttgaagataatccgtttatggcaggagccttctgggggatttcagaaggtgatgttgcgatcaacaccggtgtttccggtcccggcgtggtacagcgcgcactcgccgctgaaccagatgctagttttgaacaagtgtgcgaaacgatcaaacaaacggcatttaaggtatcacgaatggggcaatttgtcggaaaggttgctgctgatcggctaaaggtaccgtttaatattgtcgatttaagtctcgcaccgacgccggatcaaggtgattccgtcgcccagattttagaaacgatgggtcttagccatgttggcacgccaggaaccactgcggcactcgctttgcttaacgatgcagtcaaaaaaggcgggatcatggctgctgaacgagtaggcggtctatccggtgcgtttatcccggtttctgaggacgccaacatgatcacagcagcggctaatggtcaaatcagtttggaaaaattagaagcgatgacggcagtttgttccgttgggttggacatggttgccgttcccggtgatacgccggatgcagcaattagcgggatgattgccgatgaagcagcgattggcatgattaacaataaaaccactgcagtgcgcgtgattccggtacccggtaagcaagtcggtgatcaagtcgaatttggcggcttgtttggaactgccccgattatggcggttaatgatggggatgcctgtcaatttattaatcgcggcggtcgcatcccggcaccaatccatagctttaagaattaacccgctactttaaattcttagcatggaagcatttctgatggccggtttatttttttaataacgtactttgcaattgcattcgaaaaatgtcttgcccggctcatgttttatggcggcgcaaggcatttttaattgacggcgtaatctattcatgaggtgagaatgatgtttgtagctttggatgaagaaaaccggcgagtcatattaaccagtcatgaacaggcgcaacaactacgcaaccgatcgttccattgcccaatctgcaaacaacgcgttttgattaaaaatggtgtggtgatgccggcacattttgctcatcggcagcgatcagacaatgaaggagaaccggagagtgtcgaacacctgacaggtaaaagttggttggtaacctggcttcgattgcatcagcaggcggctacgttggagtactatgatgccaacattcggcagcgggcagatattcttgttcaccgtaacccgccaaaagtattggaattccaagccagtccgttaagtattcctgatttgaaaaagcgtaccacgatgtatcacgctcgtgggtgggaagtcacttggattttaggacgtcggtatcagcataaccgtggtaaaagacaggcacgaaagtttttaacgttggaagacaacttattgacattgtggtatctgaattcgcaagctggcaaacttacacgggttcagctgatgccaactggacgtctattgacttattatgttcagcggtgttctcctaaacaatgttggcaaccggaactggtagatgggttgcgtcaggctaggcatatcggtttgtctttacaaaagcgggtaccttcatggatgacgcttcaggcgttagcatatcagcagcatcataacttacacggggttccatggattgtgcatcaccgttcacatccgctgcggcattttggcatcccggaattactgttaagggttaaatggttactgacgtttgaagggcggacgtttacggatcgcgacaatttaaacttctggctggcggcgctaccgaatgtctggacgccgttgttgccagcaggaaccctcggcacactaatcggtaaacactgggtggaactgctacaaacagctgggtttattcggcgtgatcatttggggtatcgttggcgtcagttaccgcactggtttacggatattgatcacaaacttgttgctcgatcatgcatcgccccaagcgcaaagccctgagagaaaggactcagaagcaataacgacgatgggacagcgcggtcaattgcttcgttaactcctaaatgcgccggtttaagcgtaaaaaagaccctgcataatcgcagagcccgctaaaaaacagtaaattttaggttatttgatgttgccgctagcaaaaaggctgggttgaaatccaaatacaaaggttgcttcattcagacgaagactaagtgttggtgaaatcacagttgcccatggttagaaaaatcggaaatgactgcccatgttttctggtcgctcagtaaagaagtgggatggatcggttcgaatgagctcgcaaaggcggggaataagatcaggatcactaatctgttcaattaaaacggcatgcccatcatcaactttgcgatcggtatcgacaatcaccaaagatggggtttgggtaatgcccatttgattagcagtgcgttgatcggaatcaaagcccattttgacttctgaccgttgtcgatcttcgtaaaacatctcatgatctaagtggcatttggttaacattttcgctacaaacgctgcatcgtattgatattgaactaaaggcgcgtgctgttgtagtcgtaacagcaacatcctggcctttttgtttccttgatattgggcagctttgtaatctaaagcaagattataagcagctcgcaataactggttgcgtttggcgaggctgtgaacatttaattgttcgcactgcataaactgttcgataatatccagatttaaaaccggaacaaagtgaactttgacttcctgttcgaatttgtccaactggtgtagcaacttttgttcggtgctaagacagacacttccaataggattgaaaaaaagaaagatttctaacacggtcatggcctccaatttgctggcaacaaatttctatacttactttatcagaaaaccgaaaagtaacaattatttagcttgtgaatcgtgcacatgcatgtatgcacgttgcaccttattaataacgggttgtttttttatgtgaaaatggcgtagtaaatcatcgtaaaatttttgcgctacagcaagattctgatactccatttccagttcaaaatcagaagtctggtcgatataaaaggtctgatcgagcgttaacaaaccagccggcaaatgggcaagtcttctggttgtcttggcttgggtttgaggagcaaccgttgccggatcaatcccccgggcagccagagcctgagtcacttggcctgatttgagctcaccttgttcgattagtttctgtgcctccactaaactcaatggatcggtgatttcttctaagtcgcgctgggtactttcattaggcactttaagggtttgttccgcatggtcggcaaactgacggatacgcaaaccaagccgcgctgctttgacagcaccgtcagctgtgtcataataggtgttcatttggctaaaggccggttcaaaatcaaaatgattcaaaagtgctaagaaagcatttttgcttaaacaagttttgaattcctgctcgcgggaaatagacatgatttgcctccagaaacaacggcaccggttacatgccaaaaatatgatagaatgatggtcgtgagtgtcatatttagccaaagtcaacatcacgtttagctgacgtggtgacgactagccagatggacatcacattatctagtagtttagtatgggagggccagtaatgcaaagggactgggacagtttcttaatgccatatgaacaagcggtcggcgaattgaaaatcaaatttcgcgggatgcgtaaacaatttcaacaggcaaacgagcatacgcccattgaattcgtgacggggcgggtaaaaccgatcagttcgattattgaaaagcaaagtcgacggtttatcagcgatgagctcctggaacaagacatgcaagacattgctggcctacgcattatgtgccaatttgtggaagacatttaccaagtggttgacttgttgcggcagcgaaccgacatgaagattgtggaagaacgcgactatgtgaccaacgtcaagccctcaggataccgcagctaccatgtggtcatcgaatatcccgttcaattgattcatggtgaaaaaaagattcttgcggaagtccagattcgaaccatgtccatgaatttctgggcaacgattgagcatagtctgaattataaatataatggtgagttccccgatactttgaaggcgcgactcaaacgcgctgctgaagcgtcctttatgcttgataaagaaatgtcggatattcgcgaagaaattcaggaagcacaacatttatttgtctacggtaaaggccaacagccgtattcagatacaaccgatgactcaaagcctgatgataaaaaggatgaataagatgcgtgtgacagtttttcataacagcatacctgcttcaattaaagcagcgcagaaactacttaagttattaaaaaatggccattttgaactcgatgagcgccatccccaagttgtgatcaccattggcggcgatggcacgctgctgtcagcctttcaccggtatgccgaccaattggatacgattcgctttatcggcgtgcatacagggcatttaggcttttatacggactggcgtgattttgaaatcgaggatttggtcattgctttaaaagaagactccggccaaagtgtcagttatccgctattagatgttcgggcgatttatgcagatgctacgagtgcccattatttggccctgaatgaggcaacactgaagcgtctgaatggcacgatgcggacagaagtttatattaaaggcgacttttttgaaagttttcgcggggatggtctgtgcgtttcaacgccgaccggatcaactgcctatagtaagtcaaatggcggggccgtgatccatccgcgccttgatgccttacaaattacggagattgcctcaatcaataaccgggttttccggaccctcagttcaccgattattatcgcaccagatgaatgggtcactttggaaccaaccgggcgggatgattatgtgatgacagttgaccagtttgtgattaatccgccgacgattaagcagattcgttataaaattgcaaaagagcgcattcactttgcccgttatcggcacatgcatttttgggaccgtgtggaggatgcgtttattggagcaaaacattaatgcgatttgaatggcaatacgagggaccgccgctcaaattggcggcttttttaaaacaacagggtttctcccgggcccaacttaaaaagctgcgttatcaaggcggctttatttttgttaataaacggcagcggcatacagcttatccgctgcgaaacggcgatcggattctggttcaaaccgcacctgagcaagccgccgctagtgttgtcccatatgaacatgagtttccgatctgttatgaagacgatgattacttggtcgttaataagcctgctggggtggcatcgattccagcagttggccggcgaaatgacagcatggccaatatggtcaaggcgtatttgattaagacccatgcagaaagtcaggcagttcatgttgtcacgcggctagatcgcgacaccagcggcttaatggtgtttgctaagcatagtttggcgcacagtttgctggatcggcaattgcacagcgagaattttttaaaacagtacttggcgctggtgacgagtaagtcattgctgtccgcacatggatggattgtattgccaattggtgtcagcacaggattttatatgcgccgtgtcgtcagtgaaaccggtaagccatctgtgactgaatatcaaacacttgcgcaaaattcgcacgccgccgcggtactggtaacgttacacacaggccgcactcatcagattcgcgttcattttgccgcgatcgggcatccgttgtttggcgatgatctgtataatcggcaagctgacgattttaagcggcaagccttgcattgcgcacatttgcggttttggcagccgttgcaaaaaaagtgggtcgatttgcatgcaccgttaccaactgacatggcaaagcttagcgaccacttgcatttaccagttgtttattaggcatggcgtcattgatgaaggggacactggcaagtcgtttggccgcatgaagactgagacatcatttgcagcttctaaataaaagtatcccattttcacgcgatcgcgaaaatgggatactttttatttttgccactgtcaggttaaaaattccctttatgatagccggaatcagcatcgaacttaaattgtttcttgagtccgttagttaagtaaatctttttgtcgttggtgataaagatggcttgaatgtgctgactgtttttggcattcatgtactgtaagccatccttgagccccttgtcaaaagcggcgtttgacaaggcatccccgtccacgctgtttttggaaacaatggtgaccgaggccagattgttgtcgtatgggtaaccggttttgggatcaaagagatagatatatttgtgaccgtgcgagattaggtattgctcatatgtgccggcagtgacgatggattcgttgctttccgggattgtcccaacggcagtaccgcgcgcggctgtcgggtcttgaatcccgacatgccaatcacgtttcgcgccaagtggtgaatgacccatgaccacgacattaccgccaagatcaataatggcggcggtcaccccatctttacgcaagacttcgcgaaccttgtcggcaacccaacctttggcaataccgccaaagtcaagccgcatcccttttttggttaggtaggccgtgttgtttttggtgtcaagcttgacatcgcgccagttaacgagcggcaatgcctgggtgatttcgctttgtgcgggaacacgcgcaccgggcagcccgatttgccagagattggtaacagcaccgatcgccatgtcaaaactgccatttgagtttttggagaaataataggccttttccagtagcggcataaaatcttttggaaccttgacaggcttgataccggcattggcgttgattttatcaagcactgaaccgcctcgggtcaaggtagcttcggcgtcaacatgatggatcatcgcaaaaccatcttttaaagctgactttttgcctttatcgtaaatggtaagcgtacatgttgtccccatgacgaattcattgcgtgtatatggcgtttttagataggtcgcctgtgttttcttttggcacccggataacgttaaaagtcccatgaaagcaatgagaccgatgaatattttacgcatgttacttaaccctcatttcattttaccctttaatatcataacgctcgttttctaaaaagaaaaacgcgattcgccctgctgtgatttagacgaaccgatattagccaagtcaggtttaccatcaacggattaattgggtacattaaaaaggccgacctcagagacgagtttgtctctgaagccggctttttagtgtcttgaataaacaaagaaagttagaaggcgatcagtttggtgccatgaagctccttaacgcctaattgttcgctgatagtagcggcattttggctagtgatgccgccgggaagaatcgtgatttgtttttgcgcggcatgggcgatcagtgcctgtagatgtggcaaggttgtttcaattggggttgatagtgggccaccatgcgtcaaaatccgatcaacgtgatgtgcggctagccagtcaatggcggccagctgcttggtttcgggaatggcatcaaaagccatgtggaagacaacactcataccggcgcttgctgcgatcaaactcgtcatggcatcttcatcaattgtcccgtccggcagtaaggcaccgaatgcaacgccatcgacgccaagtgcctgcgcctcgaataaatcggcttccatgatctttaactcggtgtcattgtaaacaaaattgcctccgcgcggccgaatcatagtgacgaggctgcgaccatgttcgtggacatacttggcactttcagccatcacacccttggaaacggtcgtcccaccaaccgccaaattatcattgagttcaattcgatcagcgcctgcagcaagtgccttgggaatgtcggtatagttttcaacagcaatttctcgtaacatggtaacctcctgtcattatttaaagaaacatcacaagtaacacgatggcacccagaatgattcgataccagccaaacggtttgaagtcgtgcgtttggacgaatttaagcagccatttgatagcaacgatggcgactaagaaggacacgactgagccggttagtaacacaacccattgctcgccggtaaagccattgccttgcaacaaatacttgccaatttttaaaattgaaacgccaaccatggtcggaatagctaagaagaaagagaactccgtcgcaacatagcgcgatgtcccaatcaataaggcccccaaaatggtggcgccggagcgggaagtccccggaacaattgacagaacctggaacaagccgattaacaaagcggtttgataggtgatgtcggccaaacttgtaatgtgcgcgtgcttatttttgaggtaattttccaaaacaatgaataaaaccccgtaaaggatcaaagtcgttgcgacaacgagtggtgtatgtagatgtttgtccatccagtcattgagcggtaagccgacaacgacagatggcagcaccgcaatgatgactttggcccataactgccaagtatctttttgcgcctggacagtcggtttggaaaatgggtttaatttattgaagtaaagcaaaataaccgctaagattgccccaaactgaatgacgtattcgaacatgttcataaattgccgtccttgcgacaacttaacgacctggtcaaccagatcaatgtggccggtggagctaatcggcagaaattctgtcagcccctcgacaatgccgataatcacggccttgataatatcaaacataataaccctccaattctcaatgttaacagtatacaaggttttatcctacttgccataatgcaaatgcaatttagcgagatcttatataatctgtgcggtttaggatgaactgatttgtggcaagcaaaaagcggcttaagcaaattgcgttaaagccgctgttaaaagatctgattaaagccgcttttcagtttgaaagtcggctatttggttgccagaaacaaaacgttaacggcttccggagttggaatatcgcgctgttcttcggttagcagcccggttttagaatcccggctgtataaagtcccgttgctggtgttttgattaactgctaagacatagcgttcggtgaggtcgaagttgaagtcacgtggaaaatcgccggcggtactgatttgttgcagttgtgataagttgcgaccatccggactgacagcaaaaacggttaaactattaaagccgcgattagaaacatataggaaccgttgatcactacttaggcgaatagctgcggcaccattatgatccgtataatcttccggaatggtcggtaaggtagcaataagttcaaaacttccggtggcagcatcatagcttaagatgctgacctgactcgagagttccccaagtaaataagcaaccggattgttatgattaaatgcaatatggcgcggaccaaacccgggttcagcgtggaagacaacgggatcgccaagcttgccagcatcactaatcgtgtaagtggtcaaagtgtcattaccaagatcagcgactgccaagcgttgaaaatctggcgtcacggcagcgaaatggacatgggcgccgtcttgttccggacgcggaccgttaccggtgtgcacaatttcgtctgtcgtagttaagctacgatcacggttgatcttatagacgttgatgcgcccttcatgataattgctcgcgtatacaagttgacgattttcatcgattgagatgtgggcaggagaagagccgggttgtaaaacgcgattgatcagcttaggaggattaacgttgagatcataactggctacaccgccttgatccccttcagcatcgaccgcatataaaatatggtcatctgaaacggctaaataagtaggggaacctaaatcggtaatatacggttgcggggcagttaattggccttgtgtgtcgtcaaacgtaccagtataaataccagcaccgccgtgacgggtataaccgcctaacaagagtttttgtttcatagacaaaatgctcctttcgaatttgctttgagtatagcatgttttggggatgcttatgctatgatatagaacgtgagccgccccaacatagctggttaacttgctgccagctgtccttcaaagcagcggcttacttgtcccttttcgaggtacaacaagaccgacaaaaacgaacgtaccgcatcttttttagtactgcgatataggcttaaaaatatcacaagtaaaaacggaggcaacaacatgcaatttacggcaacgatcactgccattggtaaagacgctttaagttcaaaagatcccatgattattttatttggccccgaagccacagatgcactgcgcgatgttgcagtgattcaacagtttgatgatcccgcggccttatcccaattctccattcaggcgggggatcggctgacgattgacgggacagctttcaccatgacttacgtgggccagttagccatcagcaatttgaaggcaatcggtcacgttaccttgttattccaagacgtaccagctgaaaagccaatgcagaatgcgatttatctcaaaccgacccagcggccagcatttcgtgtcggaacaacattgacctataacacgcaagcttagcggttgttaattggatattaaaaaacacctgtaatgacaggtgttttttttaccatgatgccttgcgaacaccgggaatttgacctttgtgagccaaatcgcggaagttcaagcgtgacattttgaatttacgcatgtaggcatgtggccgaccgtcaagttcatcacggctgtgtgcgcgaacaggtgaagcattccgcggcaacgcctgcaaagcagcataattatgctcggccttatacttggcacgcagcggagcgtacttggcaatcgtcgcttcgatctttttttctttggcaatctttgacttcttagccatctatgcaatcactccttgtttgtggtttgtattggatactggtattcgaacagttcaacccacatagcatagcacagcaataagtcactcgcaacacttacaaaagataagcgattagtattgatcaccattgaaaatcgagtttttaacaatgacataatcgaccttggttaaagcttccagatcgcgaccaccggcataggaaacagcggattgtaaatcttcctgcatttcctttaatgtatcgccgatcttacccttaactggcagcaggatttttttgccttcaacgttatgatgggtgcctttttgatactcggaagctgaaccgtaatattcctgatattctttgccatcaatggtgacgtgcttaccaggcgtttcttcatggcccgcaaacaaagaaccgatcatgcacatggtggcaccgaagcgaatggacttggcgatgtcgccattgttacggataccgccgtctgcgatgatgggtttacgcgctgctttagcgcaccaacggacagctgcaagttgccaaccgcctgtcccgaaaccagtcttgagcttggtaatgcagaccttaccgggaccgatgccgactttcgttgcatcggcgccggcattttccagttcacgaacagcttcaggcgttccgacattaccagcgatcacaaacgtttttggcaaatagtgtttgatatgctgaatcatgtcaatgacgatttgggcgtaaccgtgggcaatgtcgatggtcacataatctggcgtcaaatcgttagcagccagcgcttcgataaaatcaaattcttcatccttaacgccaacactgattgacgcgattaaaccgcgctttttcatgtcgcggacaaaatccatgcgccgttctggctgaaagcgatgcataatatagaagtaatcgtgttcggccagccagatcgccaaaggttcatcaatgatggtctgcatattggcaggaacaaccggaattttaaacgtgtgtgggccaaatttcacgctggtatcaacctctttacgtgagcgcaccacacatttgttgggaatcatttgaatatcttcgtaatcaaaaatctgcatgccgttgttcatcggattcatcctttcgcaaaagccgaacattgttaagcattattggtgttattcaaaacaccaagtgctaagatacgcgattaaaatgtaaaagtcaaccaaaatactttcttttctttttaatgttcgtgttttgcttaaaaataagaaaagccgggatatcccggccaggtagcaagtggattagaaaaatttgtttcgccaaaattgaaaggcaagaaccatcgcaatcgcaattgaaatggcaatcgtgatgatccagctcaccttcatatctgctagtggcaagtggacattcatgccataaaatgaaaagaccaacgtgggaatggtcagtaagattgaataggatgtcagaaatttcatgacgccattcatgttattgttaatgattgacgaataagtatcagccgtttcgttaataatggaattgctaatctgcgccatttcaaccgcttgctgattttcgatgatggtatcttccagaagatcctgatcatcttcgtttagatgcaatgggttggtgcgtttgagttgttccaggacattacggtcggttcgcagactcatcataaagtaaaccaaggagcgttgaatgcccattaatccgtaaagttcttcgttgcgcaagttgcgttgaagtttattttcgttggcttcgcgggctttgttgagatcgcgcaggtaggtcaggtaactgatcgaaatctgatacagtatctgtaagacggtgcgattttgatgttgcggattgaagttgctgattttgccttccgaaaaaaggctcagcaacggtatcggttcttcgttaatcgtaatcaccgcgatatttgtaataataatggcaagcggagccgtttcataaaccactttttttcgggcgtcacgggtaacaacgggcatgtcaaaaataaacaagtggctgtcattgtcttcatcatactcataccgtgcgccttcatccggatcaaggccatatagtaggaatgcttctgatagattggctttagtctgcaattgttcccgttcttttggggttgggttgaccacattgatccagacgccgggactgatccgcgattgtggatttagccggccggttttgtcatcgaaacgataaattgaaagcatggcagtctccttggctttttctcttagtttacaacaagcggccaagctatgcaggaaggaaaatcatgcgaaaacgtgaagcaaaaattgaattggcggctcaacaaacgcctttatttgcgtgtccagtgtgcgctcagccaatgcaggtcaaagccggatcgcttatttgttctaaaggacaccggcgcgattttagtcgtaaagggaccgtgaacttcttgaatcaacaagtcgcgactgaatatacagctacgatgctagcagccagacggcgaatgttgacggcgggattgtttacaccgtttttggacgctatggcagctaaattagtcccgcatcaacgcctattagatgttggttgcggtgaggggacaccaactgcttacttggctcaccaaaagcaacagatggcagtcggtttcgatatttcagccccggcaattaacttagcgggtagtttggcagcgccagtattatttgccgtggccgatttggcgcacctaccatttgtcaacgatgcttttgacacggttatcgacattttctcgccaggcaactaccgggagtttcggcgcgtattacgaccaacaggacagctgctgaagattatcccacgcgccggctatttaaaagagctgcgtgaagggttatattctggaacacgtaaggctgaatatgataaccagcctgtgcgtgaacggtttttagcagcgtttcctcaggcaaccattcaatcaataacttatgatttttcactggctgcagatcagtttaccgatttgatgaccatgacgccactgtcttggcaagcaccggctgaacggcgccaggcaatgttaaccaatccaccaaaaagtattcatattgaggttgatttactcaccgtttcgaatcttgtcaagtaaaagggttgaaaacaggaataaccggtgttaatatgcttttaagctatttatttcgggcttttatcagggctagcttttgggtaattgataaaagtttgcgataaattacttcactaacgtatcgcttcgctgagtgcgctccgaagcaatgcgtttttttcttgcttaaaatcaggttggcgccaagtttttgactcgtaacgcgctccccggcgcaggaatctgcgtgtaaggatctgagtcgcaatgaccaagggcgggggacatcacgctcgacgctaagttcacctttacgcctataacgcgttcgccggcgcaggaatcggagtgtaaggacctgagtcgcaatggccaagagcgggccatcacgtttcaggtcacaagtctgcctttactgtcataacgcgctcaccggcgcagaagtctgcgtgtaaggaccttgggcgcaatgaccaagcccgggtcatcacgcccaaggccacaagtccgcctttacgcccataacgcgttcaccggcgcaggaatctgcgtgtaaggacctgagtcgcaatggccaagagcgggccatcacgtctcaggccgcttacactccgattcctaaccgcgccggttcacgctcactgcaggttggtgttaacacaatagaatgtgctacactgaaagcacttgtgttgaagggacgataacatggcgaatcatattgttttatttgaaccgttaattccagcgaacactggtaacattgcgcggacttgtgcagcgaccaatagctatttgcacttgattaaaccattgggatttgagaccgatgacaagcatttgcgccgcgccgggttggattattgggccaaggttcgaattgtctatcatgatagtcttgatgacttcatggcaacggtcaaggatccgcagcatttgtatctcatcaccaaatttgcagatcaaacctattctgatcgcgattacaccgatacgcatgccgaccactatttcctttttggcaaagaaaccactggactgcctgagggatttatgcgggaacatgaagatcagtgccttcgcattcccatgactgcaaacgtgcgcgcactcaatttatccaattgtgcagcattagtggtttatgaagctttacgacagcagcattttgccggactggaaaccgtgcatacctatgaacatgacaaactaaagtgaaaatacgctaggaggcgcaacccatggaagcaaaacgttatccgattacggttgaatcatttcattatgatctcgtgaaacaaggaaccccagtgaagaacgatttacaggtagccatgcgtcagattcagtggtctgaccctaagaaacaggcagaattaaaaaaaggcaatctttttgaaatgatgattccctttgacgtggtgcctgacaatgccggatttgaaatttccggcaagatcacccaaattgttcaggttatggattatttcggtgaagcaaatgagctgccacaagaagaactaggcaaattgagtcggccactggttgaaaccattgaaaccttgacctatcaggtgacagcggtagccttggatcaaggcgttaatcttcagttcggcgcaagcgacgaacaacctggccaagcttaaacaggtagtgaatagggaaagatcaaaaaggcggccggaaagctgccttttttgctgagcgcgagccggcgcggttagggatcggagtgtaagtggcctcaggcacaatggccggtctttggccattgtgcctgaggtccttacacgcagatccctgcgccggggagcgcgttatgggcgtaaaccagaacataagtggcctcagccgcaatggccgggctttggccattgcgcccaaggtccatacacgcaggctactgggctggcgaacgcgttatgggcgtaaaccagaacataagcagcctcagccgtgatggccgggctttggccattgcgcccaaggtccatacacgcaggctactgggctggcgaacgcgttatgggcataaaccagaacacaagcagccccagccgtgatggcctgagcttgcccattgcgcctaaggtccttacgctctgacttctgcgccggaaagcgcgttatgcccaaacatacccctggctaatgtaaaagccgacataacgacacaccgcatatctcaaaagaacgtaacaaaatcaccgcagtggctttttaaatgcgggctcagctcgtgtataataggcaggaatgaaaggagcatgaccatggcacaaaaacgcggcgggcgcaggcgaccgcgcaaaaaacgaccaactaaacagcaacagcacaccttaagttgggttggcgcgctatttgtcgtgttcgcgagcctggcatttttccgtctcggcattgttggaacggtccttgccaacgtttttcggttagtagttggcgatagttttctggtagtcagtgctgcgaccgttgtgaccggtatctggtttttactagcagatcggttgccgaagttagcgcggcatgtctggatcggactaagcatcattctaatcgctgcattggtgttgctaacagcacagacaatggcgacgctgaatgtccacagtcattatttgctagcgacttggcgcctgttgcaaaatgattttgggctaatgacgaccgcgtcacaagtcggaggcggcttgcttggtgcaggactttttgcgttgttggcaccattattaagtagcttaggcgcaaccattcttgcgtggtttggtgttattgccggtatcctcgtgtttttgggggtgggcgccaaccaggtttttaactggttgcaagcttttggacaggcttgcaaacgtggattgattcaggtatctgatcacataacggcgctaagacaagcacatgctaaaaaagctgccactcgtccaacatcgacgccaaaagctgcaacggatgctgctcacacgcaatcagaaccatcatcggagcgagccgatgacttcacgattaaggggccaactccggttaaaccgttgccgcaaagtgaagcgcctgccccgacgaaaccagcaagtaccgcacctatgagtgagtcatctgctgccactgcgcaggtgcccgccagcaagctggactcagacatgccggcttcagactatcagttgcctagcctagccatgctgacggcgacaccgcctgtcgaccaaagtgcagaatatcaggcaattaaaacgaaccgtacaaaactgaaggaaacttttgaaagctttggggttaaggtgggcgttaaaagtgcgacattagggccgtcaattacgcaatatgagattcagcccgcggtcggcgtaaaggtttcaaaaattgtgaatctatccgacgacttggcattggctttagctgcaaaagatattcggattgaagcaccgatccccgggaaatcgttaatcggaattgaagtgcccaatcaacatattgcaacagtcgggtttaaagaggtcatggcggagacgcctaaggcaccgaatcatcccttagtgttaccacttggccgggatgttaatggtcaagtggtcacctttgatctaaccaaaatgccgcacctactaattgccggcgcaaccggttcaggtaagtcagtgatgatcaatgtgatcctgacgagtatcttgatgcgtacgaagccaactgatgtccggctgatgttaatcgatcccaaacgtgttgaattgtccgtttataatggcgtgccgcacttattgacgccagtcgtgaccgaagcaaaaaaggcgccaagtgctttaaataagattttaaccgcaatggatgaacgctaccaacgatttgcggcagcaggcgtgcgtaacatgaaagaatttaatcaaaaagtagcagcaaatcctgccagtggtcagtccaaaatgccgtatatcgttgtcattattgatgagttaagtgacttgatgatggttgcgggtcacgaaattgaaaccgccattgtacgactggcccaaatggcgcgcgctgccggcattcatgttatcattgccacacaacggccatctgtggatgttatcacggggttgatgaaggctaacattccatcacgtattgcttttgccacatctagcggcattgattcacgtacgattcttgacagtaatggcgcagaaaaacttctgggccgcggtgatatgctgttttcaccgattggcgcttccaagccattacgagttcaaggtgcgtttatcccgtctgttgatgtagaacgggttgtgaaagctatcacggatcaagtggcaccagcttatgtagacagtatgacgccgactgaaaatgtcgaaaccgagcaacaaggggattctgaagacgagttgtacgatgatgccaaggcatttgtcattgcacaacaaagcgcttctacatcgatgctgcaacgacgctttcgaattggctataatcgtgcggcacgattgattgacgatcttgaagctaatcagattgttggccccagcgaaggcagtaagccccggaaagttttcgtcaccccaacagatgggaatcagtcatgagggagactatgcaaaaagaaatcaagccgggcgtttggcttatggttttgccaaccacccaatttaaaaccactcggatcaatattcagtttttaaccccattgcggcgagatacggtcacaaaacgaacgttgctgaccagtcttttggagacaaatagtcaggagtatccaactcaagcagctatggcggcccatttagagtcactttacggtgcaaacttcagtattggtgttgcgcgcgaaggccgactgcaccgggttggggtgacaatgagtactgtggacgatcggtttacggatgcaccgttgttaccaaaggcagcagcgtttttgaagacggttttgttttctcccaactttcaagctgggcaatttgacgcggcaacttttgatcgggaaaagcaaaacttggatcactatctggccagcttagatgatgatcgccaaacgcaggcagcattgggcgtccagcgtctgtatttcggcgttgatcctgatcaggctatccccagctttggcacgcgtgaagatcttgccccgatcacgacagcgagtttaaccgcctattaccatcaaatgatcagtgaggatcaagtcgtcatcaccgttttgggcgatgtccaggctgaaaacgtggcggctttgtttgctgattggccactggcggcgcgctcgcaaaccacccctgcgattgcatttaatttaccggagcatgctgaagtcgtcagccaaaccgccaaagtcgttgcccaacaagctaaatttgatcttgcctatcatgtcagtacggatttgatgggtccaaagtatgcagctactttagtggcagaagaattgtttggcggttcaagtttgtcattgctcttcaccaacgttcgcgaaaaggccagtctggcttactacgcgagttccatgttggatacttttcgcggcttgatgttggttcaaaccgggattgaaagcaaagatcaggcgcgggttgcggatttgattcagcagcaactggcagccattgtgcgcggcgatttttccgatgaccggttgcaggcgattaaagatggcattttggatcatcagcgtgcagcgtatgatagtccgcggtttttgacaaatcaggcgctgtatcgactgttggtgccggacgcaccgcaagactttgaaagctttgctagccgaattcaggcggtggatcggcaggcagtgcaacaagcggcggccgcgatgaaactgcaagcgacgtattttctgactggggaggacagcgaatgaagacacaatatttccgtgatgttgatgaaacactcatcacaacgacgctgcccaacggtttgcgcctgcaagtggtgccgcgcccggcttatcataaaagttatgcgatcatgaccactgattatggtgcgattgatacgcgctttgctccggacggcaaacagatggtgacttatccagccggcatcgcccattttttggaacataagttatttgaaaaagaagatcatgatgcatttgatcttttcggcgagaccggtgcgtcagccaatgcgtttaccagtgcgacaaaaaccagcttcttattttccacgaccactcaattcaataagaacctgcaaattttgcttgattttgtgcaggcaccgtttttttccacggaatcggtggctaaagagcaaggcattatcggctcggaaattcaaatgtatcaagatgatccaggttggcgggtgtatgctggtttgttggaaaaccttttccccaatcatccagcgcatgttgacgtggcaggaacagcagcaagtatcgctcagattacgccggagatgctttataccattcaccgcgttttttatcaaccaagcaatatgactttggtgattgttggcaatattgatgtggagaatgtgattgattttgttgctgccaatcaggctcaaaagacatttccaacgcgacagccaattgtgcgaggcgttgaagcagacgtgcaaacagcagatattattccttatcgggagttgaaaatgccggtcagtcgtcccaaaacgctggttggctttaaaggacaggtggcaattccgcagacggctgctggttggcagtatcaattaagtattcgcctattgctggaagttttgtttggggattcatcgcagctttatcaagcatggtatgaccgcggtttgattgatgactcgtttgattttgattttacgaatcagcgtagttttagttatgggcttgttggcggcgacaccgatgatcctcaaggcttaagcgccgccatcaaggaagtattggcacatgctgcggatcaggctgatttgaatagaaatcgggttgcgctaattaaacgcgcgtcactcggcaaatactatgccggattgaatgggttaaatggcgttgccaaccaactaagcgccttaagctttggcgaagcgtctttgtttgattttccgcaaatattaaacaggattagttttgaagatcttgagcagttaattcctaaactttttaatactgaagctttaacggttttgacaatgcttccggaggggaaataatgcgatcggcgttaatcattggcgcttctggtgatattggccaagcggtagcagcaaaattggcggcagcagggtggtcgctttatctgcattactttaagcatgagcaagttgtgatggatcaaatgaaggcttatcaagcagcatatccgcatcaggactttattccgttacaatatgatttgacggatgaccgtcatctagacgaactcacaaatcaactttttagtcttgatgctgtcatttttgcagctggcatgacctattatcatctttttaaagaaaccaccgtccctgagatgacgactttaatgcgtgtccatttgttaacgccgatggttcttttgactaaagtggagcgtaaattggcacaatctggtcatggacgcgttattttcattggatctgtctatggtggtaccggatcagcgatggaggtggcctatagcacggtcaagggagcgcaaagtgcctttgtgaaggcttatgcacaagaagttgccagtcttggcattaccgtgaacgttgttgcccccggagccgtcaccaccaaaatgaatacaaaaatgtttgactccgatacactcgccaaagttcaggcagagattcccgcggctcggtttgcgaccccccaggatattagttactatgtcagtatgctggttgccaaggatgcggcttatctaaccggacagacactgtacgtaacaggcggctggcgcatgtagtaaacaaaggatttcttaaggctttcagacggtttttcatgctatactgaaaatggttaataaaaaatagcgggtgaagaaaacatatggatgaaattgggcaaaaattacgggacgcccggattgaaaaaggctataccattgatgatctacaacaaattaccaaaattcaaaaacgctacctgattgcaatcgaagaaggtcatttcgatgcgttgccaggcgacttttatgtgcgtgcctttatcaagcagtatgccgatacggttgggcttgacggggatgaattgttgacgcaatttcagcaggatatcccggaaccgcaaccccaagaatacgctgcacagtcagttgaaaataagactcgggcgacccgcgccgaagaagcgagtccggttaaccgtttgcggcgttatctgccacagattgcgattgctgcctttgtgattgttgccatcatcgtcatttatgtcgtgatgctattttcacaatccggaccgaaacaaacgattcccgcggattccgagagtgttgcggtttcgtccaagcgcagtagttctaaggcatcgaaatcatcaaaaacctcatcatcctcgaagtctagcaagtcttctgcatcaagtagttccaagtcatcagaaaaggcatctaaagaaagcaaaaagaagagtgacaagctcgacatttctgttgctgcggcaaatggtgctactcaggcagttacgttgaagaatttgcctaccagcgggaataaacttaccctcggtgcaaacggggcgaccgcttggatttcagtcattgtcaatggttcgacaacttggcagggttccttgacatcaggaaatacacaagaggtgacattgccagataatacgtccaccttccaagtccgctcagggaatgcgactgctacgacgattgagttgaatggcaagaaggttgacatttcgaacggtaccagtgttgttcgaacgattaccttcacaagcagtacgagtgaaagtgaggcttctcaagaatgaatctccctaataagttgacgctgattcgcattttcttaattcccgttttcactttgttattggcattcaattggccggctggttatctgacaattgccgggacaaaagttgccatgagctggtttatcgccttgattatcttcattgtggcctcacttaccgattttgcggatggtcagattgcccggcgcaaacatttagtgaccaattttgggaaatttgccgatccgttggccgataagttgttagttatgaccgcatttttgttcctgacagcagctggacagattccagcatggggaacggcgattatcctatggcgtgagttagcggtgacgggtttgcgactattgctttccaatgaaggagaggtactggctgctgcttggcccggaaagattaagaccaatacgcaaatgtttgcgatcatctttttgatgctcaataacgcatggttcaacaacattaacattccgtttgcgctaatccttttctatgttgcagtgttcttcacgatttattccggcgtggaatatttttacaagaatcgcggcgtttttgcagattcatttggatctaaacagtagtaatatcgtttttttacccaggctgatggcttgggtttttttgtgcccgtcattcggcgcaaaacggaacgggtagtaaaataaaactgaagcttgttgggtttggaggcattgtttatgttaatggttgggtgatcgcagcagaatttttgaatattgagtgaatgcattaaagggcagatgtgctaaacatcgaattctattgttaggtgggaaaaatatgcaagcagaaattattgctatcggaacggaaattctgatgggacaaattacaaatacaaatggcgcgtatatggctaaacaactggctacattaggtattgcgagctatcatcaacaggttgttggggataatgcaaaacgactggctgacgcgataagtttggcggaacaacgcagtgatatcgttattttgattggtggtttaggaccaacaccggatgatttaacgaagcaaaccctagccgcacacctgaatttacccttggtggaagacgctgacgctatggccaagttggctgcgcgggttaaacaacagcaacgtccaatgacacccaataatcgcctgcaagcgatgtatccccaaggcgcaatcgtattggccaatcgtgtcgggttggcggtcggcgcatgggttgagcagcgccaacacgcctatgttttattgccgggaccacctaaagagtttgtgccgatggttgatcatgaactgttgccacgactggcaaaatatagcgggcatcaagaagttttggaaagtcgcgtgatgcgtttctttggtatcggcgaatcgcaacttgtgacagacttaagtgatttaattgccaaccagacgaatccgacacttgcaacttatataaaagatcatgaggtgacagttcgggtaactgcgagtggcaaaacacaagcagaagccgcggcgaaacttgagccaatgatcggcatcattatggatcgtgaaggtcgctacttttacggctacggtgacgataacagtcttgcccaggaattagtcaaagcattggcggctagtgataagcaaattagtgccgctgaaagtctgactgcaggtgcatttcaagcggcattgggagacgttccgggagtctcggcttatttcaaaggcggcttcgttacgtacgctttagcgacaaaagctgcatttttaaatattgatgcccgtcagctatcagaacatggtgtggtgagtgaatttactgccaaagcaatggcagagcatgctcgtcaacgagcggcggcagacattgccgttagttttaccggagttgccggtcctgacaagctggaaggacagccagccggcaccgtctggattggtttggcgcggttaggagagaaaccaatagcacaagtttatcattttccgggtgggcgaaatgacgtccgcaagcgcgccgttatgacggggatgatgatggtgttgaagcgtttacgcgaataacagcaaatagttgtggatggaacaagctcattaaacaggaggcggtaagagatggcagaaaccgaacgacaggaagcattggcaacggcgttaaagaagattgagaagaattttggcaaaggggccattatgcggatgggggacaaagtggagacacgcgtttctgctgtttccagcggatcacttgcaattgatgatgcacttggtgttggtgggctgccacgtggacgaattgttgaaatctatggtccggaaagttccgggaaaacgactgtggccttgcatgcagttgccatggttcagcaacacggtggcacggccgcttatattgatgctgaaaatgccatggatcccaaatatgcggcggcacttggcgtcaatattgatgagctgttgctttcacagccggataccggtgaacaaggattagaaattgccgatgagctggttgcatcgggcgccattgatattttagtggttgattcagtggcagctctggtaccgcgcgcagaaattgaaggggacatgggtgatgcacacgttgggttacaggcacggctaatgtcacaggccttacgaaagttgtctggggcgatcaataagaccaaaacaattgccttgttcattaaccagatccgggaaaaagtcggcattgtattcggcaatcctgaaattacgccaggtggtcgggcgctgaaattttatgctactgtgcgtatggaagtgcgccgttccgagcagatcaaaaacggtgccgatattattggcaatcgcaccaaaatcaaagtggttaaaaataaagttgcaccgccgtttaagactgccattgttgatattatgtatggtcaaggcatttcccaaagcggtgaacttgtcgacatggcggttgaaaaagacatcattgaaaaggcgggttcatggtatgcctaccaaggcgagcgcattggtcaaggacgtgagcacgctaaaagctatcttgaaacgcatgaggagctgcgccgaaccattgaaaaacaagtccggcttgcttatggaatgtcgccggatcacgttatcgatcaagcagacatagagacagatactaccacatctgccgcatcatgactggttaaaaggggtgcttgttgtgttgcgagcggatcgggtgtgaaaatggctcacgcttttcataacgcgttcgtagtcgcggcaatcggagtgtaaggaccttgattgcaatggtcaaaatcgggccatcacgtatgaggccacttatgttctggcttacgtccataacgcgctcgccagcccagaaacctgcacataaggaccttggtcgcaatgaccaaagcccggtcatcacgcctgaggccacttatgttctgttttacgcccataacgcgttcgccagcccagaaacctgcacataaggaccttggtcgcaatgaccaaagcccggtcatcacgcctgaggccacttatgttctgttttacgcccataacgcgctcgccagcccagaaacctgcacataaggaccttggtcgcaatgaccaaagcccggtcattacgcccaaggccacttatgctccggtttctaaccgggctggctcgcgctcactaaatttgcctccagttgacaccttgcaggccagcacgtaaactaatagaggtgtaataatttaaaaaaagcatcaaagattttgatcaacttgatgattgaatcgcttagatgatgcggaggtgaaatgatgagttcagtaacactggtctcaataaccctcgcagcagtcatcgctttagcggtcggtttattgatcggatttgcacttcaaaagaagctccaccagaacagtttggatcgagcgacgcagacagcagaaggtatcattgaggccgctaaaaaagaagcagcgactttaaaaaaagagaaactgctagaagcaaaagatgagaatcatcgctatcgaacccaacttgaagacgaattgaaagatcggcgggcggaagtccagaagtcagaacatcgactgaaccagcgagaagatactcttgatcggcgtgatgacacgcttgatcgtaaagagcagagtcttgctgaccgggaagcaaatttgaacaagcggcagcaacagttagatgaacgtgaacaagctatctcttctgaaatcagcaaacaacagacagaactcgaacgaattgccgagctaagccatgagcaggctcggactcagatccttgaccagacacaatcagaattgacgcatgaacgcgccgtgatgattaaagaaagcgaagatgaagcaaaggaggccgcagataagaaagccaaggtactgattgcggatgcaattcagcgcagtgcttcagatatcgttgccgagacaacggttacggttgttaatttaccaaatgacgacatgaaaggccgaattatcggtcgtgaaggtcgaaatatccggacacttgagactttgacggggattgacttaattattgacgataccccgcaagccgttgttttgagcggatttgatccgattcgacgggaaatcgcgcgaatcgcgttggagaagctcattcaagatggccgaattcatccggcccgcattgaagaaatggttgataaggcacgcaaagagatggatgaccgcattcgtgaaatcggcgaacaagctatttttgatgtgggtatccataatatgcaccctgacttgattaagattttgggtcgcttgcattttcgtacgagttacggtcagaatgttctggatcattcgattcaggttgcaaagctggccggtgtgatggctgctgaattaggagaagatgttaccttagcaaaacgcgcggggttattacatgatattggtaaggcgctcgatcatgaagtcgatggatcccacgttgaaattggggtcgagctagcaacaaagtacaaagaaccaaagacggtgattaatgccattgcgtcccatcatggtgacgttgaaccaactagtgtcatttcggtactagtcgccgccgctgatgctatttccgccgctcgtccaggcgcgcggtcggaatcacttgaaaattacctgcatcgcttagagaaattggaggctattgccaacagtcatgctggcgttgaccatagtttcgcgatccaggccggtcgtgaagtacgggtgatcgttcagccagaaaaactttctgatgatcagagtgtcattttggctcgcgacattcgcaatgaaattgaaaaagaattagagtatccgggtcacatcaaggttacagtcattcgagaaacccggaccgttgaatatgctaaataagtttgcagttaggccttattaaagggcactatatgtaaaccaaaaagatccgcaagcggtaattgagcttgcggatctttttacgtttttaaggcttgtgaacttctgacgtggcataagggacctcacgatactgacttgtaccgatctgtgggtcaaattgtccgtgtaggaaatccttgattaaggcgaggttcttgtctaactggtcagcatcaagatgtagcgtcagtgtcactgctacgccataatcaatggttgcgattgtgaggttgtgcgtttctaaaaaatgctgcagtggatcaagatccgcatatggaatctgaaaagtaacagccttttgtttaattcgggctacaatgccaattgtttcaattgcggcgttgacattgccggcataagcgcgaatcagaccgccggcaccaagcttgatcccgccaaaataacgcgtcgtcacggcgagtgtatcgcgaagttcatgttgcaagaggccttcaagcgtcggggggcctgcagttccggatggttcgccgttatcgctggcccgctggatttggttttcgttaccgagcacgtaagcaaagacattgtgatttgctttggcatgctcgtggctgatgcgatcaataatagcctttgcctcgtcttcatcatgaatacgagcgaggtgggtgatgaaacgagactttttaatgatttgagtgtaatttccggattcttttatggtgagatatggcttcattatgcgtaatctccttttgaggtgatgaaaatggatctggcaggtgcccaactcacacagcgtgaactggcgcgtttagctgtttctaatatatcacacgcaactgttgtgccggcattggtaaaagaccatcatcagtggcaatgtcagcgatgttgcagccgcagacctgttgcactgccagatggccgaatctactgttcggagtgtgttgctttaggacgactgaccaatgccgatcatctttatcggtttgaacaggcgcatctgccggttggtgatggtcaattaacctggcatggtgtactaacacctgatcaacaggcggcatcggatgcattacaggcgagtgtcgcagcagggcgtgagcatttgatttgggcggttaccggagcgggaaagactgaaatgctttttccgactattgcccagctgatccagcagcaaaagcgggtggccattgtttcaccacgaattgacgtgattcgggaactggcaccacgatttcgaacggcatttgcaaccacacccatttccgtgcgttatggtgggcattttgatcaaacggatagtgatttgcttttagcaacggttcatcaattattacgcttttatcgggcatttgacttaattgtcgtagatgaagttgacgcgtttcctatgcgcggaacaccgatgttgcatcaagcagtgagacaggcacgccgcggctcaattgcttatttgacggccactcctgatcgtcaattaaaacaggcaattcggcgggggcggcttggggttagtcgactttttcgccgttttcacgggcatccattaccggttcctcggattcaattagtgaacttacggcatgtgccccatcagcttcccaaagcagtcattgtgtgggtgcagcaagtgctagcgactaaaagagtctgtctgttgtttgtgccgaagattagttgggcagaacaacttgccggtaagttgcgccaaatagggctaaaggcggctggtgttgcgagtactgatgcgcagcgggcggaaaaggttacagcatttcgacaaggacaattggaggttttagtgacgacaacaattctggaaagaggcgtgactgtccctcgctgtgcggttgcagtgctagcagcggcagatcccgagttttcggcatcagctttaattcaaattgccggtcgagctggtcgggcagcggatagtccggacgatccggttgtcttcttttccgatcgttatacccttgcgatgttggcagccagacgccaaattgtgatgatgaatggcaggtgaagacgatgcgctgtattggttgtacccgcccgacagatcgcggcttgaagctgacaacgttattttcccgtggtccattgctagcgccgaggttatgtcacagttgcttgagccaatttagtttcattaccggtataacctgctccggctgcgggcgaatgcaggtagccgcggagccatgtttggactgtcgaaaatgggcgaagcatgggccgcttttaaataatcgggccttatttgtgtatgacgcgaaaatgaaggcgtggatttaccaatataaaggactgggtgactatcggctgcatgtagcttttcaggatttgattgccgagcgtctgcgacatgcagaagcgttggttcccattccaagcgaagctaaacattatgaatggcgcgggtttgatccgattttaggattatttggttgcctgccattacaaaactggctccaaaagtcggcaacagcgcgaccacaagctcaaaagacccgccgagaacggctgaagacgccacaaagttttcgggtgctcgtttcagccaaaaccttaaaccgcgtgcgtcagataacattgcttgatgatttgtatacgacggggcggacgttgtaccacgcgcgggatgctttagtggctgccggtttcaaggggactatccaggcgtttacattaattcggtgaaatgtggcttttgttgtgtctggtggtaacattcgggtataatgaagttggagattggaagggttttacccttagctatggctacgttagccgcacggagcggtataatgaagttggagattggaagggttttaccccagccaatcagcgtgtaagcgttttgcctacacgcaggaaaggggagaagttttatgctcacatacaatgttcgtggcgaaaacatcgaagtcaccgaagccatcagaaattacgtggagaagcggattagcaaactgaacaagttctttggtggttcagttactgcgacagcgcacgtcaatttgaaggtttacccagataagaccgcaaaagtagaagtgacgatcccgctgtcgttcttgaccctgcgtgcggaagaaaccagtccggatctgtacgccagcatcgatcttgttactgacaagctggagcggcaggtgcgtaagttcaaaaccaagattaatcgcaagtcacgtgaaaaaggctttggtcagattgacatcgatagcaatgcaccggctgaaccgaaaccggccgaagatgatgataatctgaaggttgtgcgaacaaaacgcgtttcgttaaaaccaatggattcacaggaagccattttacagatggatatgctgggccacaacttctttatcttcgaagatgcagatacaaatggcacgagcattgtttacaaacgtcgtgatggccgttatggcttgattgaaacgaacgaataatagcgattttcttaaaagaaaggcaaggctgctgcttatcagcgggcttgctttttatttgcctgtcagctccatcatgcctataaaacgatgcgtgtggctattacagtttatgagaagtgtggcaattaatgtgatttttgacgcggagatctgtatttaaggatcttggtcgcaatggccaagagcgggccatcacgtctgaggctacttatgttctggcttacgctcataacgcgctccccggcgcagaattctgcgtgtaaggacctcagacgcaatggccaaagtgtggttatcacgttcaaggacgctaatgttctggtttatgcccataacgcgttcgccagcccagaaacctgcacataaggaccttgggcgcaatgaccaaacccgggtcatcacgcccaaggccacttatgctccggtttctaaccgggctggctcacgctcaccaagttattttcaatctcccctttaaaatgttaagatgttagaatgtataaatgttaagatgtataaatgttagaatgattaaagtagtgttagttctacgaggtttcgacagagaggaatccattaatggccaatattcttagaaaatgggtcgaaagcgataagcgagaaatcggtcgcctcggcaaaatcgctgatcaagttcagcgctatgaagatgaatatgcagcattatcagatgatcaattaaaagcaaacacccaaaaattcaaggatcgccttgcagcaggggcaacgttagacgatattttaccggaagcttttgccaccgcgcgtgaaggggctaaacgagttttggggttattcccgtttcgggttcaaattatcggcgggatcgttttacatgaaggcaatattgcggaaatgaaaaccggtgaaggtaaaactttgacggcaaccatgcccgtttatttgaatgccttgactggtaaaggggtccacgtggttaccgttaacgagtacttgtccacgcgtgatgcaacggaaatgggcgagttgtacaactggctcggtctcagcgtcgggttgaatcttaactccaagaacagtgacgaaaaacgcgaagcctataactgcgatatcacctattccaccaatagtgaactcggttttgactatttgcgagacaacatggtggtttataaggaacagatggtacaacggccactgaattttgcaattgttgatgaggttgattcgattctcattgatgaggcccggacacctttgattatttccggtggcgcagaaaagacaaccggcctttatattcgggcggaccgcttcgttaagacgcttaaagccgatactgattacaagattgactggccaacgaagaccatttcgctcactgaaagcggcattcgcaaagccgaaaagaattttggcttggataacctatacgataccgaaaatacggctttaacccaccatatcgaccaagcattgcgggcaaattacattatgcttaaagatatcgactatatggtgtctaacggcgaagtgctgattgtcgatcaatttaccggtcgggcaatggaaggccggcgctattccgatggcctgcatcaggcaattgaagccaaagaaggggtccaaatccaggatgaaaataagacgatggctaacatcacttatcaaaacttcttccggatgtacaccaagctggcagggatgaccggaaccgctaaaacggagcaagaagagttccgcgaaatctataatatggaagttatttcggttccaaccaataaaccggttatccgggttgattcaccggatgttttgtacccgactttggatgctaaattcaatgcggttgttgacgatatcaaaaaacgtcataaaaaagggcagccgattctggttgggacggttgcgattgagtctagcgaacgtttgagtaagcaattagacgatgaaaaaatcccgcacacggttttgaatgcgaagaaccactttaaagaagcggaaatcatcatgaatgccgggcaacgaggcgctgtgacaattgcgaccaacatggctggtcgtgggacggatattaaattaggccctggtgtcaccgagttaggcggtttggctgttattgggaccgaacggcatgagagtcgccgaattgataatcaattacgtggccgttctggtcgtcaaggtgatccgggttctacccaattttacctgagtctagaagatgacttgatgaaacggtttggctctgagcggatcaaagcaatgctggatcggttcaaggttgccgatgacgatcaggtcattcaaagtcggatgatctcacggcaggttgaatcagcgcagaagcgtgtcgaagggaataactacgacacgcgtaaaaacacgttgcagtacgatgatgtgatgcgtgaacagcgtgaagttatctataagcagcgccagcagattatcaatgaagacgagaccctgaagcccgttttgatggcgatgattaatcgaaccatcacccgcatcgttcaaacgcatacccaaggcgatcaaaaggattggaatcttgatgcgttgtatgcctggatcaccgcaaacatggccgatccggagaaattcaagcgcagcgaacttgatggcaagtcgcaagatgagctcatcggtttactggcggatatggctgaaactaacttccagcataaaaacaagcaacttggcgatgacgcgcagatgctagaattcgaaaaagtggtcatcttacgcgttgttgactcagcttggacggatcacattgacgccatggatcaactacgccagtctattggtttgcgtggttatgggcagatgaatccgctagtcgaatatcaagaagaaggctaccggatgtttgaggaaatgattgcgtcaattgatgatgatgtgacccgattgttcatgaaagccgaaattcggcaaaatattcgccgttaatggtgaaccggcgccccggcactgcaagctcaaatttgcggtactggggtgttttgaggataacagaagcagaagctaaatgtaggattgaggcaacccggtctttactaaaatcaacttaaaaaaagaggagcaattatcatggaactcagtgtcatgcgtaacaccttggccgccatgcgaaccaaaataaatcaattcagggggtctctttgacctcgatgcgctgaatgaacgcattagtgaaaatgaaggtagaatggcggaaccgggcttttgggatgattcggaagcagcacaaaaagtgatcgatgccaacaataaactcaaagaaaaacacgatcgcttttacgcacttgaaaatgaactggaagatcttgaggctggattggagttgttacaagacgaacccgacccggatttgcaacgcgaagaagagaccaagcttaaagatctgcaggaaaaacttgatcagtatgagatgcaattgcttttaaatgggccatatgaccacaacaatgcaattctcgaaattcatcccggtgcaggtggtacggaatcacaagactggggttcgatgttgatgcggatgtatcagcgctgggccgaccagaatggtttcaaggttgaagtcgcggattaccaacccggtgacgaagcaggcattaaaagtgtgacgcttttgatcaacggtgagaacgcatatggcttattgaaaagtgaaaaaggcgtccatcgcctcgtccgcatttcaccatttgattccgccggccgccgtcataccagttttgcctcggttgatgtgatgccggagcttgataattcgattgaagtcgatattcgcccagaggatatcaaaatggaagtgtttcggtccagtggtgctggtggtcagcatattaacaagacttccagtgcggttcggctgattcatctgccgaccgggattgtcacttccagtcaggcacaacggtcacaatttcagaacaaggccacggcaatggcgatgttgaaagccaagttatatcagcgtgaagaggaagccaaaaaggccaaagccaaagccattcaaggcgagcaaaaagatgttgcttttggctcacagattcggtcttacgttttccacccgtacacgatggtcaaggatcaccgaacgaattacgaaaccggtaatgggcaggcagtgatggatggcgatcttaatccatttatcaatgcatacttgcaatgggagctcgcccagaaaaatcctgattaaactgtaatctgcctgaaatcttgctgacttaatcggctgttatactaatcctagcttagaaaaaggagcaaaatgcatgattcaaatggaaaacgtgacgaaacagtatgctaacggcgtcactgccattaaggatttgaatcttaaaatccaggatggtgagtttgtttacgtcatcggtcctagtggtgccgggaaatcaacgttcgttaaaatgctgtaccatgaattaaagccgtccagcggtagtattaaaattgatgattttgatttttcaaccatgaagccgtcgcaggtgccgtttttgcgtcgtcacatcgggatcgtctttcaggacttcaagcttttaccacgcttgacggtgtacgagaatgtggcttatgcgatgcaagtcattgaagcgccggacgataaaattaaagaccgcgtgctcgaagtattaggactcgttggcttggaacagaaattgcggcgttttcctgatgaattatccggtggtgaacagcagcgggtgtcagtagcgcgtgcaattgtcaacaagcctaaagtgttgattgctgacgaaccgactgggaaccttgatccgcaaacctccgatgaaattgttgatattcttgaacgtatcaatgcaaatggaacaacggttatcatggcaacccataacaaggatattgtgaatgaacgtcaacaccggctactcgaaattgccgggggtcgcttagtgcgtgacgaagaaggaggcacatacggcaatgaagagtaaggtctttttccgccatgttaaagattccctgcgcagtttgcggcgtaacggctggatgtcggttgcagcggttagtgcagtcaccgtcacattactgttggtcggtatttttatggccttgattttcaacctgcaccacatttcacaacaagttgaaaatgatgttcaggtgcgggtttatattgataaaaaaacaaccaccaaacaacgtgatgaccttaaagacaaacttaaaaagctggatcacgtcaacaaggtcacttaccgctcacgtcaacaagaattagatacaatcatcgggggttatggttcgcagtggcggatgttctccggggatcaaaacccattaagcgacgtgttcatggttaagacgaatagtcctaaggccaccatcagcgtgtcaaaagaagcacagaaactggatcatgtggttgatgcaagctatggcgggcgaacggcaaagaaactctttaattctgtggatgtagcccagaaatggggacttgctttcacgattctgcttctgtttgttgccgtgttcctgattaataacacgattcgaattaccattttgtcacgttccgacgaaattcggattatgcgattggtgggggcaaccaattcttacattcggtggcctttcttgcttgaaggtgcctggaccggtttgtttggggcggtattaccgattattattgtggatgtcggttatgcgattgtctatcggagcttcacttatgcaaacggagccagtggttatacgctttatgccaatatgccgttcttgttctggcttgacttgatgttagccgggatcggcattgtcatcggggcgctgggatcagttatctccatgcggcgttttcttaagttttaatttcaaaattgaacatttgagttgctgctatcgactcaatgtgaaaggattgctcttttccgggcagtccttttttggtgggtggttttaatgaatggcagtacgatgttttgaatacgcaagcttatgtcgaaaataactcatacatgttaattgatgggacaaaaatggccgtttttcggcattttctggttgatgagcccaaaaccttgtaggaagcggtcgttaatttctgctatactggtcacagtgaatattggagggttaccgatggcagtgatcattgccttacttatcagcccgattggtgccgtattctggcttgctttagggttgacgattttgtatgcggttagccggacaagccgcgaacgccatcagtacttgcgggcgattcatccccaacatagcgaaattgccccattcttttgggtcggtattttgctaggcatcgttatctcggcactgatgttggttgcgcgcttacaagttagtttgcccgcattattagcattaagtggctcaacgctggtcgggctaatcttttctggctggcggttcagtccatggtggctaggattagcgggcttagttgaattgctgcggccgacaacgagccaaatgagtgctgatttagccgttttagttggtgtgctgtggttagcacaagctttgatcgcgcggttaaatcggggcgctcaaattgagtccccggttattttgcaggatcgacgtcaacgtcaacaggttgcgtttcgattgcgacagttttactgggtgcctttgttcttaccggtgagtgttgatcaagttgcgggattgccgctcttatcaatcgcaacggatacttttgttgcggttggacttccactggtcttaggcgcggcatttaccacgcagcgtgatcgtgttcaaccgtatttgcgccgaagttggccatggtttgcagttgccggtggcggtttgatcgtctttggactggtgggtcggatccttaccatgcctgcgatgacaattgccttagtacctgtgttggtgagtttgatactcggtgccggcttagtttggcaagcacatcaagtacatttaaacgtgacacaaaccaatcacggggtggttgtcatcggggttgtcccacagacaccagccgcacaaatggatttgcagccgggtgatcgggtcttgacctgcaatcatattgccgtcaacaatgccgctgaactttataacgcaattcaaaaggaacccacttattgccgcttacggcttcaacaggcagatggcgagatacggctagccgaaaccgcaatttttgccggtgcaccccatgaacttggtatgattttattcccggaggagacagcatgaagaagatcttgattgttgatgatgaaccagccatcttaaccttgctgcaatacaatttagaggctgaacactatcaggttgaaacggcaacggatggtcaggaggctttagacaaagtacgtagcgagccgtttgactttattattctcgatctcatgttgccgagtttgagtggactggatgtcacccgtaagattcgtgaagaaaagattcaaacgccaatcatgattctgacggccaaagacaacgaaaccgataagatcgtcggacttgaacttggtgcggatgattatgtgaccaaaccgttttcgccgcgggaaattattgcccgaattaaagccatcgaacggcgtagtcaaagtcaaccacaagcgccacttcctggtaatgccaatcaaattacggtcggtcaaattacgattgatcctgaaaattataaagctagcaaagccggacaccgactccaattgacccctaaggaatttgaactattggtttattttgctcaacgagttggcaaaacgctatcacgcgatgctttgctcaatggggtttggggcttcgattacccggcggaaacacggatggtcgatattcaggtcagtcatttgcgggataaaatcgaaacagatcctaaacatccggattacttaaagacggtgcggggattcggttatcaaatggaggcgccacatgaataaacggattttacgccgtgtactggttattagtctgctctcgttagcaggcttttttgtactcgtcacgacggtcaatcaacaaatcgtacatcagcaggcacgcgatttgaggcgcgtagccagaacctatgcagcctctgctaaggatggcgttgatccgcaagcgctggcaaagtccgaagccgcttttattacggttgttccggataatcccaaaaccacccgacaaaaagtgatggccgatgccttacgtggcaatcatcgcgaaccatttgtgacaacggttaatgttcttgggcgagctgaacaggcatatctgtttcgtcaccggggacactgggttgccgttagtcgctataagtccagcgtttggacaacggcgcctgagcaattttggattttgacgctgacatttgcggtcctgattgctttaattctggcttggctttttcgctcggagcatcagtatcaagaagccattcgggtcatgagccacaacttggatcggattcgccagaaaaaagagcccgagcctgtgattctgccgccacagtcgccgtttacgcctgtggcacggcgaattaatgccttagctgcggaacaaacccatttacgtgagaaagtcgcagtacggcagtccagttttgatcgtctgattgataatttgccactaggcgtcatgttgattgataccaataaggatgtcattttgcataatcatgccatgtcccagcttttgggccatcagattccgcagccgcggcacaattatctggacgatgttaagacttatgcgttggcccggatgattgagcacacttttcgccatgaaaagactcatcatcaggagttgaccgtcctggcaacccaaaagtcggttgatgccagtgtcattcctttaaaccaaggaactagtcgtctccaggtgttggttattttgtacgatgtcacgtatttgcgccaagtcgagaaaatgcagctcgattttgttggcaatgtgagtcatgagctaaagacgccggtgactgctatttccgggtttgccgagacactattaagcggggctaaaaatgatccggcgacgctagataagtttttgaagattattttcgatgaaagtaagcgactgacccagctcatcaatgatattctaacgttgagccggcccgaatcgaatcaaacggtgcaggcacaagtaccacttaagaagttagtcgacgatgcattgcgtaatttagctaaagtgattaaagacaagcagattcgggtggaggtggcaattgcaccagacttacaggttgtgaccgatgagcgcaagttaactcagattgtgcggaatcttttgaacaatgccgtgttttataatcgattagccggacatgtgacgatcacggcccaagtagtcgaagggcacttgtcattggcggtcgctgataccggtattgggattcccgagacagagcaggcacggatttttgaacgcttctatcgggttgataaagcgcgcagtcgtcacaatggcggtactggtttgggtcttgcaatcgttagtgagctggtgaaaagtatggatggtcaggttgccgtttcgagtcaagtcggggttggatcgacctttaccgtgacattgccggtcagcaagcgccagcagcaagattgatgagatatttacagaacctttacattcaacgacatgaacatttacacgcaactgttaagatgattggagcttgaaatggaggatttcgtgtgaaaaaaattgtgaccctgttttcgatcgtatttttggcgctgttagcaagtgcatgtggcagcagtcatagttcgaaacagtcgggtgaatcaatcaccgcagttggatcaagtgccttgcagcctttggttgaagcggcgggcgaacaatatcagacggaacatctcggcgtgtttatcaacgtccaaggtggcgggagcggtaccggattaagccagatccagcaaggggcggttgatatcggtaattcggatctttttgctgaagaaaaaccgggcattaaagccaacgccttggtggaccataaagtggctgttgtcgggattgcgccgattgttaatcccaaagtcggtgtgaaaaatgtgtcgatgacgcagttgcaacagatctttctgggtcagatcaccaactggaaacagttaggtggcaagaatgtgccgattgtccttgtcaaccgcgcacaaggttcggggacccgcgcgacttttgaaaaatgggcgcttgaaggcaagcaaccgattgccgctcaggaacaggattccaccgggatggtgcgacaaatcgttggcagtacgccaggggcaatttcttacgttgccttttcttacgttgataaaaccgtccgcagcttgtctgtagacggcgttgcaccaactgatagtaacgtggcaacgaatcgctggcatatctggtcgtacgaacatatgtatacaaaaggtcggccaagtggtttgaccaaacgatttttgacttacatgatgtcaccggccattcagaagaaactggtccaaaaaatgggctacattccgatgactaaaatgaaagtggtgcgtaatgccagtggccagattagtcgtccgtaaacgagtccagcgtctaaaagctttttcggcttacgaattgatgaagcaagtcagtgtgggcagttaggttcaggcaacctagcagatcaatgaaggcagatgcggccaggacgatggctagttgcggtgaggttttaggaggttatgatggatccaattcgagaagcgatgctaaaaaaatcgcgctcatcaaagttagagcgacgcggcaaaacgatcagtctgatttgtatcagtctgattgtacttgtagtggtggcaatatttttctttgtcgcctcaaaaggattagcaacattctttcaaaataagattaatttatggtcgtttttgagtaagagtgtgtggaacccatcaattaaagatgcccatggaaatccggaagttggcgctttaccgatgattgtcgggtctttcggcgtgacttttttatcggcaatcgttgcaacgccatttgcagttggcgcaggcattttcatgaccgagatttcccacaagtgggggcaaaaagtgctacagccggttattgagctgctcgtcgggattccatctgtggtttatggcttcatcggcttgtccgtcattgtacctttcattcgccatatctttggcggtactggctttgggatcttagccgggacttttgttttgtttgtcatgatcctgccgactgtaacatccatgaccgtcgatgcgttaaaagctgtcccgcgccattatcgcgaggcttcgttggcgctaggtgctactcggtggcagacgacttatcgcgtggtgctgcgtgcggcaattcccggcattttgaccggtattgtttttgggatggcgcgcgcttttggtgaagcgttggcggttcaaatggtcattgggaatgcggctttgttgccaaagaaccttgtttcgccagcttcgacgttgacttctgttttgacgagcgggattggtaatacagtcatgggttcgctggaaaataacgctttatggtctttggcattgctgctgttgctgatgtcattagcctttaacctgttgattcgttggatcgggaagaaaggggagctgaacaaatgaatccaaaagttgttgataaaattgccacaacggttctgtacattgtttcagggattatcattgttattttggccagtctcctcgggtacattctttttaaaggggtaccgcatatttcctggcattttctcacgagtccagcacaaagctttgaagctggaggcggcattggtattcaattgttcaattcgttttatcttttagtccttgcgatgctgatttcaacaccgatttcgttaggggcaggcatttacctcagcgagtatgccaaaaagaattggttgacggatgttattcggacttcgattgaaattctaagttccttaccgtctgtggttgttggactgttcggttttctgattttcgttttacaattcaaattcgggttctcgattttatccggggccttggcattgaccgtcttcaacctcccgttgctgacgcgaaatgttgaagattcattacgcggcgttggctttgaacagcgtgaggccggcttagcgcttggcctatcgcgctgggagacggttttacatgttgtcatccctgaggcattgccggggattattaccgggatgattctaggtgccggacgggtttttggcgaggcggcggcgctaatttacactgctggtcaaagtgccccggcgctggatttcaccaactggaatccggctaacattgcgagtcccttaaatccatttcgaccggccgaaacgttggcggtgcatatttggaaaatcaactctgaaggcattcaacctgatgccgttgctgtttctgccggagctagtgccgtacttgtgatcgccgttttggtcttcaacgttggcgcccgctatttaggcaatcgactatttaaaaagatgacggcggcttaaacgggttaggcttctagtatcaatgaggcttacccggtatgataatcgcgataatacgtggaggcagaggatgcaagaactggaaaagtattcattagatgacacttatattcgaccatttgatcgcgaaaagcaggaaattgcgcttgaaacggaagatctgcatgtcttttatggtgataatgaagccattcatggcgtttcgctgccgtttgaacgctataaaatcactgcattgatcggttcaagtggctccgggaagtcgacatacttgcgctcactcaatcgaatgaacgataatattgaaagtgcgcgagtcaccggtaaaatcatgtaccggaatattgacatcaatagtgatgcggtcgatgtttatgagatgcgcaaacacattggaatggtatttcaacggcctaatccatttgccaagtcgatttacgacaatattgcttttgcactgcgtcggtttggtatcaaggacaaaaagaaactggacgaaattgttgaaaccagtttgaaacaggctgccttgtgggatcaagttaaagacgatcttaatcaaagcggtatgtcgctttccggtggccaggcacaacggttatgcattgcacgggcgattgccatgaaaccggatattttacttttggatgagccggccagtgccttggatccgatttcgacatcggcagttgaagataccttgttgtcattaaaagataagtatacgattatcatcgtgacgcataacatgcaacaggcggcccggattagtgactacacggcgttcttttatagtggagcagcgcttgagtatgatgaaacccgtaaaatcttcacgcgtcccaagattaaagcaaccaacgattatgtttccggacatttcggctaggaggttcccatggctgaagcacaaaaaatcattacaagttcagatgttcatcttttttatggtaagtttgaagcgctaaaagggattaatctggattttaacgaacatgagatcacagctttaatcggaccttctggctgtggtaagtctacgtatttacgaacgttgaatcggatgaatgatctgattccgggagtgacgattacaggaaccatcagtttacgcggtcagaatatctatgcgcctagtgaagatgtggttcaattacgtaagcaagtgggcatggtcttccaacaacccaatccgtttcctttctccatttacgaaaacgtgatttatggattgcgtttggcaggggttaaagataaaagcattttggatgaagcggtggaaaccagtctcaagcaggccgccatctgggatgaagtgaaggatcatctgcatgacagtgcattatcgctttcaggtggccaacagcagcgggtttgcatcgcgcgggtattggcagtcaaacctgatgttgttttgttagacgagccgacgagtgccttggatccgatttccagcacgcaaatcgaaaacatgttactcgagttgcgtgatcaatacacgatcattctggtgacgcatagcatgcatcaagcatcccgaatttccgataaaaccgcctttttcctgacaggcaacctgatcgaattcgctgacacgaaacaaatgtttttaaatccaaaagaaaaggaaaccgaagactatatcactggacgcttcggctaggaggggtagtatgcgacgactttttgttgacgaattgaacgatcttcatgtacgtttttcggaaatgggaatgatggttaatgaggccatctataagtccgtgaaagccttcatcaatcatgacaaggctttagcccgcgaagtgatccacgaagacaaacacattaacgagcgtgaagttgatttggaaaaacgcagcttcgaattgattgccttgcagcagccggtgacgaccgatcttcgggtgattgtcacggtgatgaaggcaagttccgatctggagcggatgggggatcatgccgtttcaattgctaagtctactattcgagttaaaggtgaaacccgggtaccgcaaatcgaagctgatattgccgggatggcagacgcggtaaaagagatggttgaacaggtgctggatgcctatgtgaaggaagattcagcccgtgcacgtaaaattgccttggaagatcacggtatcaatgacttttcatcgcggatttacaaagagtgtatccgccagatgcaggaaaaccccgaaaccgttgtcggatcaatggactatatgctggtttcgtcctatcttgaacgaatcggcgactatgtaaccaacatttgtgaatggattgtctacttaaagaccggtaagattaccgaattaaactcaaacgcaattgaagacaagttctagatcctggagacttttttgaacgaggctggggcatcattcattgtttcaaaatataagcgtaccatttctcgattttttaagaaatggtacgctttttggcttcttcatattagtataaatgagctttaacgattccagtgccaaagcggagcaatcgtaggctagatggggctcagccgtggaacaacacagcgaccggtttttgtcgcggggctgcttcgcgtcaagtagacaagtcaaataattaaaattgctatgcgatttctttcacggcatgattccgatattccagcggagtcatgccgtttagtgtttcctgacgtcgtttattgttgtaccaatcaacgcagcgctgaatcaattgcaccatctctaactctgacagagcatgttcgaacctgaagaattctgtcttcatgtggctccagaagctttccattggactattgtcacctggggtgcctggtcgagacatactgtgggtgatccccagcccgaccaatttcatattgtagccccgtgacgtataggcagagccttgatcactgtgcagtatatcgggtttgagtctaccagtattcttcagtgcggcctcaaccgtattggtgaccaatagagtcgtttctgttggtgatacgcgccaagccacgatactgtgatcgaacaagtccttaacggcacttagacgcagtctatactgcattcgatcaccataggtcaactcactacagtctgtcacccaaaccatgttcggacgctctggagagaagtcatgaccagcatcgttagtcagtaacttattggcaaagcagtattcttttttctcggcttttcgatcccgtttagcaacacgaatggcggccacgatatgatttttatgcatgatgtttctgacccgggtcgcaccgacatggaatcgtgtctcgcggttgatataaattactaatcgacggacgccaaagatgtagtgattatcttcttccaaagacttgatatactgagcaatttctttgttttcctgggcgtggaccgatggcttacggttgcgccatttatagaaagcagctcttgaaatctctaaaaattgacaggcaaagctgatgccataaggctgcttagtatcgagatttatttctttggcgagcgcctccacggtacgatatttttcttctgttgggcatccatcctttcgatttcctggagtttttttaatatggcggcctccgttgagacgtatttaagccgggccttgagtcgtttgatctctaggtccttcttttccatttcagtcagctgtccgttgtcttccttgtctttaccacggcgatcaagcaacgcgtctggtccgccctgtacatatttcttgacccacgaataaacctgaccataagagaccttgaagcgtttggtggcttcaatgtaatttttattgttggcaatcgtccattcggctatctcaatgcgttcagcttggcttgtgtcccgaccgtctttcacgggtgtacccctcctgttagtggtggctaaagatttaccactagtatacagggaaacccattgataaatcacaccatggttaggaataccgtactgtcgtgcaagagcaggggatgaagcttttctttcgagaaaagccttaatcacttctagcttgaactcttccgtgtagcgcgtatgagaatctctgggctttaggcccgcttccccctccgcttcatatctgtcaacccattgggtgatctgagcatggtcgatgccatacttcttttggactgctccagcagtcatccctcctgcaacaagaccaatgtaaaagagcttctccttcaatgtgtaacgtgaaccttttcggcccataagaaaactccttccaagtaaacgggttttaattatttacctgtctaccttagaaggagtataccccgctgatgttgttaggcgacttggagactgccggggcttgcaggctccaagcgccgtctccgctctagcttcgcgtcgccaccccatctggccggagattgcgtagtttggcacggcccggaattacttgagttactttctcagtcatagtattcggattttagtgcgcatcacatcctgagatagaattatgcctcagtcccttggcttattcatatgagtacaaatgagccttgacgattgcggcgtttggcgcgacacgggactatttgacttattttctagcgatgatattcgaatttggtgagtagcgaattctgaaatggagtgatgtcacaccctcgttcattccacctttttagaaagcagtgaggtgtcgagatgatcactaagttgcgcgtgtccgccttacgacctgtttaaaaatcaacctttggacctatgcgccttggccaaattccgtgcatactaatcatgtaatcaaatcctggagggataacccatgaatgaacgcgaaagaattttagacctcgttaaaaaaggcgtcatttcaagcgaagaggcgctggtgcttttggaaaacctcgcaaaacagcaaggtacgcaagccggcagcccggccgatgatactgctcccgaagctcattcggaacagaccgaaaccgatgatcaatcaacgcaggaacaacaagaagctaataaagatacggatgctgcattgacagagcttaacaccgaaattgccgaagccgctggtgccttggatgctgcgacggcgcaagtgacaagcatcggtaagcaaattgaagcgaataacgaacaaattattgttttagacacaatggaagatctcgaagcactttccccggaaaaatatcaaaagcgcggggaattgaagcaagagaatcagaaacttaacgatcagttagccgagctaaagggacaggttgaaaccatgaaggccaacctggcaacgttgcggcgtcaaaagcatgatcttgaacgccaaaagatcagtgacaaaatcttcaacgatgactggcaaaaagatgctcgtgatgtcttttcggagtttggcaagaatatcggggatgccacgtcacaactaggcggtttcgttaaggacactgtcaacaatgtcctggataatgttgactggaagaatgttactgtaacggttcccgggttggcgactgaaaaatttgaacatgttttcaagtttccagacagtcaggcgacgattctggatgtcaaagtggccaacggtgatgtgaagtttaagacttgggatcagccgggaattcaagtcgaagcagcgattaagttatacggaaagatggatgccgattcaccgtttgaagcttttaaagatcgtagccgcattgatgttaccgacgatcattttagcttccaggtgccaaataagcgcgtccaggctgatctggtcatttcgttgccaaagcgcacttacgaccacgtgtcagttcgtttgttgaatggcagtgcggatttaaccggtgtgaatggtaaagacttttatgttaagagcaccaatgggcaaatgaattttaccaatgtggacggtgtgatgattgaaagcgaaggcgtcaatggatcgattaaggttcaaggcagccatacccatgacttattgttgacgactgttaacggtgatgtttcagtcgatgccgatccggcaacagcagcattaaagacggtcaatgggacggttcgagccacttatcacacggactttaccaaaattgaagggacttccatgaatggcaatgtgaaagtggcggttccggcatctattgcactgaaaggtgaagcccgtacccattttggcagcattaagagccgacttagcaacgttgcggagccagccaaaggactcaagcgttttgagttagaccggcccggaaccggcaacagcgagttgaaactcaatacaacaagtggcaacattcaattaaaagattcaaatgactgaggggatcgcttatgccttttctaataattccaattatgttcttcatcgttggcctggtactggtggccgtgtttgcaatcggtattttcttgctaaaactgttaatcgttcccgccttgttagtggtgttagcggtttggctgttctcacgccatgatcatgagaaacggcaaggtccgcgccacccttatcgtgatcagagcacgtctcgtccgcgaaaaaacgcaacgcatgtgaccgaatcacgtgatgatgattggagcgatttctaatcatgaacttcatcaaacgcgcagttataacgacagctgtcttcctgatttatgcgcaggtgtttcctggtcagttgttcgttgcgagctttggtgttgccgttgtcggggcactcgttttaggggttctcaatggcttgttgcggccgattctggtcgttttgtccattccgattacgattttgacactagggttgtttctgattgtgctcaatgggctgatgttaagtatgatgacatggttcgttcccggaattgttttcagcagtttcgggtcaacgatggtacttgccatcatcatatccgttttgaatatgatctttgtcggcaagcattaagtcagtttaacgataaaagagtacgtcacgagattagcgttatgtaaaaataaatcggtcttaaagatgtttcctgtctttaaggtcgattttattttgtctaaaagattgggtagtggataagtgcgtggaaaatgcccattttcaccattgacatattaaacgccatcgtttcagaattaggcgaatgttttggggcgagctgctatgagggctggcgagttatggtaaaataaagcaaatacggcgaaagaaaggtggacttcatggcagacagcgtgacagtacggcaacttgtcaaagcgacaaagcttgaggtatacagcggctcggaatatcttgatgcccggcaagtcgttttgagtgatatttcgcgtcccggccttgagttaacgggttactttaattattatccacatgaacggattcaacttttcgggcggacggagatttcatttgctcgtaatatgtcttcagaagagcgtttattaattctgaaacggatggcaacagaagatacaccggcttttctggtttcgcgaggattgcagccaccggcagaaatgatcacggcagccactgccgcacatattccggtattaggatcacggttgccgaccaccaggctgtcaagcttgatcaccgaatacttagacagccaactagctgaacgtcgcagcatgcatggcgtcttggttgatatttacggtctgggcgtgctcattactggcgattccggggtgggaaaatccgaaacagccttggaattggttcagcgtggtcatcggctcattgctgatgatcgggtggatgtttatcagcaagatgaacaaacggttgtcggagctgcaccgccgattttatcccacttgttggagattcgcggattgggtatcattgatgtcatgaatctctttggtgccggtgcggttcgtgaagacaccaccatttcgctgattgtgcacttggagaattggacaccagacaaaaccttcgatcgcctgggctctggcgaacagacgcaaatgatctttgacgtgccggttcccaaaattacgattccggtcaaggttggtcgtaacttagccattatcatcgaagtggccgcgatgaatttccgcgccaaatcgatgggctatgatgccactaaaacatttgaaaagaatttaaatcatctgatcgaacataacgaagcgaacgaccagaagagttcggaggaaaaataacttgttattaacactcaatccaattgcttttcagttgggtgggctggaagttcactggtacgggattattatcgccagtgccgttttactggcggtttatctggcaatgaaggaagcaccaaaacgcggtattaaagaagatcatattttaaatctgattttatgggcgttgccatttgcgttaatcggtgcacgcctttattacgttgcttttgaatggtcttattacgcggctcatccaagtgaaatcatcgcaatttggcatggcgggattgccatatacggcgctttgattgccagtgtgattgtttttgcgatttattgtcgcgtcaaatggctgccggtttggctggtgttggatattgcggcgccaaccgtgatgttagcccaggcaattggccggtggggtaatttcatgaatcaagaagcccatggtgccatcaccagtttggcttacttgcgtggcttgcacctgccagaattcattattcaacaaatgaatatcggtggtgcttatcgccagccaaccttcttatacgaaagcatgtggaatctcgttggttttgctttaattatgacggttcgccatcaccaacactggtttaagcaaggggaaatcgtcttgggttatgtcatgtggtatagttttggacggttctttgttgaaggcatgcggacggattcgttatatgtcataccaggcttgcgtgtttcccagcttttgtcgattgttttattcgtggtggcggccgggctcatctggtatcgacggcggcgtggcgatgtcgcgtggtacttagacggtaatccactgcaggcggttgaataggagtgattttgtgccgacaaaaatagcggttttaggagcgggctcatggggaaccgtgttagccaatttgttaacggaaaatggccacgaagtcgatttatggagtcataatcctaaacaggttgcgaccatgcgagaaacccgcaaaaatgaacattatttaggtgcagaatttaccttacatgatgcgctgcatgtcacggctgatttaggccaagcattagatcaagccaatgtgattcttttcgttgtgcctaccaatgcgattcgcagtgttgccgaacagattagacccattctgcaggctcatcgtggtcgtggtgaacagccgattattgttcatgcagccaagggattggaacgcggcagtgagctgcggatttcacaagtcttagctgatgtccttcctaaagaactcattcaaggcatcgtggtgatttcgggtccaagtcatgccgaagatgtagcgactcatgatatcacaacgctgacagcagcatcggcagacttatcactggcaaaaaaagtccagcggttattcatgaatgactattttcggttgtacaccaatactgacgtgatcggagttgaaatcggagccgctttaaaaaacgttatcgcaatcggggctggcgcgttgcatggtctcggatatggcgataatacgaaagctgctttaatgactcgcggcctggcagagatcagtcgggttggggtcaagttaggcgcagacccgttgacgttcatcggtttatccggcgtcggtgatttgatcgtcacctgtacatcggttcacagtcgtaattggcgtgccggtaatgcccttggccaaggtgagaaacttcccgatgtgttgaaaaatatgggcatggtggttgaaggtgtttcaaccaccaaagttgcccaccacatggcaagtgagttgggtgtcgatatgccgatcaccgatgcgatttatcaggttttgtatgaagacgcgccgattcgaacggtgattaccgatctcatgaagcgaaccggcaaacctgaatttgattttgataatgccagtttacaaaaaccataaaaccctgtatattagaacatgtagcttactatttgtaagcaataaggcaaaaggagagacagcccatggcaaaaaaatatgatgtaatcgtgatcggtgccggaccagggggcatgacagcagcactttatgcttcccgagccaacttatcagtgttaatgcttgatcgcggcgtctatggcggtcagatgaacaataccgccgaagtagaaaactatccgggttacaagtctatccttgggcctgatcttggccagaagatgtacgatggtgcaactcaatttggtgccgaatatgcgtacggcaacgtgatcagtgtccaaaatcacggcgctaccaagttggtcaaaaccgatgaagacgagtttgaagctaaagcgattgtcattgcgactggcgctgaacacaaaaaactcggtgtacccggcgaagaagccttcagtggccgaggggtatcgtactgcgcggtctgcgatggtgcgttctttaaggatcgtgaacttgcagtcattggcggcggcgactcggccattgaagaaggactttatttgacgcagatggccaaaaaggtcaccgtcattcatcgtcgtgaccaattacgggcacaacaaatcattcaaaagcgagcctttgcaaacgacaagatgcattttgtctggaatgcccaggttcaggaaatccaaggcgacgatatgaaagttaccggcgtcaaatatcgtgataaagaaaccggtgaggaacatgttttgccagttgccggtgtcttcatttacgtcggcatcatgccaatgaccgagccattccaggatctgggaattctggacgatcatggctggattccaacggatgaacacatgcgaaccaaggtgcctggcatctttgcgatcggcgatgttcgcgccaaagatttacggcagattaccactgctgtcggagaaggcggcaccgctggccaaggcgtcttcaattatattcagagtttgaatgataccagtgttgaagtaaaagcctaagttttgacgagtcttttaagaccattcaccaattgaatttgatcaaggaacggttctggcagacacgaaaatctgttaggaccgtttttgcttttaaaaataccacgctattgcgaatatgatggcaaaaatcgtaaaagaattttcttatttgagcgcgttttcaacccagcgttggtcacttatagtatgattggacagggaagggtagtacccgaaattatcaatttagacagataggagctgatcacgtgagttatcgtgatacgtatcaacaatgggtagatgaaccaacgcttgatccagagctaaaagctgaccttaagaaaatggcagacgatgaaacaaccaaagaagaagcgtttgcggaaccaatggcatttgggactgccggcatgcgcggtgtgcttggtgccgggatcggccgcatgaatatttataccgtccggcaggcgactgaaggcttggcacggtttatggataccttgactgacgaaactaaggctcggggtgttgctattagttacgattctcggtacatgagtcaggaatttgcctaccaaagcgcaggcgttctcggcgctcatggcattaagagttacgtctttgatcaactgcggccaacaccggagctgagttttgctgtccgtcacctgaagacatatgccggaattatgatcacggctagtcataacccgaaacaatacaatggctataagatttatggccctgatggcggtcaaatgccaccggaagagtctgacaagattaccaagtatgcccggtcggctgatgatctttttgccatcaaggccttgaatgttcatgagttgcgggctaaggatttgatgcagccaattggtgaagatgtcgatgaagcgtattatgctgaagtcgcaacggttacgattaatcatgatttgatcaacaaggttggcaagaacatgtcgctggtttatagcccgttacatggtaccggtcggattccggcacaaatggtcttgcgtaatgccggatttgaaaacttccggttggttgcgaaacaaagtgttgctgatccggaatttgccacaaccccattcccaaatcctgagtttgcccaagtctttgatttgccaattgaactcggcaagaaaattggtgccgatgtcctgattgccactgatcccgatgctgatcggctgggaactgcggttaaagttggcgatcactatcagttgttgaccggtaatcaaattgcgtctgtgctattgcattatattcttgaagcacgtaaacaagccggaaccttgccaaagaacggtgcggtcgttaagtcgattgtttccactgagttggcaacggctattgccaaagattatggcgtggacatgatcaatgtgctcaccggcttcaagtttatcggtgatcagatcaaacatttccaggcgactggcgaacatgaattcctgtttggctttgaagaaagctatggctacctgatcaaaccgtttgtgcgtgataaggatgccattcagtcaactgttttgctagccgaagtagctgcttactaccagtcacaaggaaagacactttgggatggcgttcaggaactgtacaagaagtatggctactacgctgaaaagaccgttggcgttgattttgaaggcgttgatgggcctaagcagatggctaatctgatgactaaattccgtgaagaacagccagatgattttgctggcgttaagatcgcgaaagttgaagatttcctgagccaagaagctaagtctgcagatggcacagttgaaaagctgacgatgccatccagcaatgtgctgaagtatattttggctgatggtacctggattgcaattcggccatctggtacagagccgaaagtgaagttctacgttggcaccaaagccgatacggatgcaaaggcgcaagaaaagcttgatgcctttgagaaagctttggatgcttttcgtaaggaagcttagatgaacgattcgcgtggtcagcggttgctgttgtgctagtgaatgcaatgtgataatcgcggataaaagtgtattttaaccgatcgatcctaaagggaagcctttggggtctatttttgatttgtcttaaatgcagtagccgtgacaataaagatagcgccagggctagaagtatacgggaaagtgagcgtttccggtttccgttgctgatttctttttctgggggggtcgttgtggctggtctagcgctttgatcaatgttcttcgcattcatttttgggatattggctgataccctggagtggaaaatgtttcagggctctaattggttctaacagcgccggttcacgctctctttttgtgaattttcttgcaatggcttcttgatggtggtagtcttttaacaatttaagtaaatttcacgatcagacacgacaactatcaggaggtcatttcgaaatgggcatgcaccaatttatccaaggactgagcaatctggaaacactgcggcgggcaccgggctttttcaagtatcaggagcattcggtggcggctcacagtttcaaggtggcggagatcgcgcagatgttgggcgatgttgaggagttagctggaaacaaggttaattggcagatgctctatgagaagtcactcaatcatgattataccgagcgcttcatcggtgatattaagacgccagtgaaatatgcaaccccaacgttacggcaaatgttggctgacgttgaggctaccatgacggaaaacttcatcaaaaatgaaattccacgcgactttcaggatcgttatcgtcggcggttatctgaaggcaaagacgaaacgctcgaaggtcagatcctgagcgttgcggataagattgatttactgtatgaaggttttggggaaatcgaaaaaggcaatccggagcaggtttttctcgatatctattcggaaagtttaagtactattttgcagttcaagaatcgtccgagtgttcgctactttcttgatgaagtattaccggatatgctggatgagaagttcgccagtcgggatcaactggctaaattgactaaagaaaccatggcagaacatgagactggcaagtagcgaaagtatgttcgctatgttataatatgcaggatgaaagttgggatgcgtttcttatcggttccaacttttttaatgagaaggttttagtgtggttgtgagctttgcgttggccggttagcgctcgccataacgcgttcaccgggccagaaacctgcacataaggaccttggtcgcaatgaccaaacaccggtcattacgcccaaggccgcttatgctccggtttctaaccgggctggctcacgctcacttttctttggaggtacatcgatgattgaacgaattgctgatcgtaaatttgatttggtttcgccttataagccagccggggaccagccccaggcgattgctaagctgactaaggggtttgaagaaggtaaaaaggcgcaaattctgttaggtgcaaccgggaccgggaagacgtttacgatgagcaatatcatcgccaacttgaacaaaccgactttgattttatcgcataataaaacgttggctggtcagctgtatggtgagtttaaggagtttttcccacataacgcggttgagtacttcgtgtcttattacgattattaccaacctgaagcctatgtgcctagcacggacacttatattgaaaaagacagtgccattaatgatgagattgataaattgcggcatagcgctaccagtgcgttgcttgagcgtaatgacgtgattgtcgttgcttcggtatcttctatctttggtttgggtgatccgcatgaatataagaaccatgtgttatcgttgcggactgggatgaccattgaccgaaatacgttgttgcggcaattagtagatattcagtttgatcgtaacgatattgattttcaacgcggtcgttttcgggtacggggagatgtggtggaaattttcccagccagtcgtgatgatcacgccatccgcgttgaatttttcggtgatgaaattgatcggattaccgaagtcgatgctttgacgggtgaagtgattggtacgcgagatcatgttgccattttcccggccactcatttcatgacgagcgatgaacagatggaacgcgcaattaagagtatttctgcagaactcgaggatcgcttaaaagtcttgcgcggtgaaaataagcttctagaagcccaacgattagagcagcgtactaattatgatattgaaatgatgcgcgaaatgggcttcaccagtgggattgaaaattactcgcgccacatggatggtcggaaacccggagaaccgccgtatacgttgctcgactttttcccgaaagactttacgattatggttgatgaaagtcacgttacgatgccacaggttaaaggcatgtataatggcgatcgggcccggaaacagatgttgattaattatgggttccgtctgccaagtgccttggacaatcgacctttgaagattgatgagtttgaaaaacatgtcaaacggattctttatgtgagcgcaacgccaggaccttatgaactgagtcgcgttcctaaagaagatattgctgaacagattattcggccgaccgggttgttggatcctaaaatcgaagtgcgtccggtgatgggccagattgatgatctggttggcgagatcaacaagcggattgatgcgcatgaacgagtcttcatcacaacgttaaccaagaaaatggcggaagatttaaccgactatcttaaggatatgggaattaaagtccgttatttgcatagtgacattaagacgcttgaacgaacccagattattcgtgatttgcggctaggtaagtttgatgtattgatcgggattaaccttttgcgtgaagggattgatgtaccggaagtatcattaattgcgattctggatgccgataaggaaggcttcttgcgggcagagcgttcgctgattcagacgattggccgggcatcgcgtaatgaacatggtaaagtcattatgtacgctgacaaggtcacggattcgatgaaagccgcgattgatgaaactcggcggcgacgggcaattcaagagaagtttaacgaagagcatcacatccaacccaagacgattattaaaccgatccgggcggctatttcaacctatgagcaatcggatgacgaaaaagccgatgccaagaagacttttgcagaagttgattacgaagatatgagtaaagcagataagaaagaactggttgccaacctccgttcacagatgcaggcggcggccaaaaagttggactttgagcaggcagcttctttgcgcgatacgattttggaattgcaagcggatatgtcttgagaatgaggtggacaggacttgcatgatggcaccaactcagccatgattgctatgagcagatccggcgatcatggctgttttcttgctttcgaattaggcataagtgctgaggcatttctagtttgtatccgccagtgctaccagttgtcggcatgttttaattgaggagatcttttgtgaatggcaaatgataaaattgtaatccacggggctcgggcccataacttaaagaatattgatgtgacgattccgcgcaataagcttgtggtcatgacgggcctttcaggttccggtaagtcgagtctggcgtttgatacgttatatgcagaaggccagcgccgttatgtcgaaagcttatctgcttatgcacgccagtttcttggtcaaatggagaaaccggatgttgattcgattgatggtctcagtccggcaatttcgattgatcaaaagacgacttccaagaatccacgctcgacagttggaacggtcactgaaatcaatgactacttgcgactgttgtgggcgcgggtcggtcatccgatttgtcctaacgatgggacgccgattaccagtcaaagtgttgaacaaatggtggaccgcgtcttggctttgccggaaaagagccgcattcagattctgtcaccgattgtgcggcggaaaaaaggcagccataagaaagtctttgccaaaattatgcgtgaagggtatgtccggatgcgcgttgacggtgaagtcatggatgccacagcggactatgaactagacaaaaacaaagcccatgatattgatatcgtgattgatcggattgtggtgaagccagaagcccgcagtcggttatttgactcttttgaagcggcgttgcggctttcggaaggatacgctaatgttgacgtcattggtggcgatacactgcgtttttcggaacattttgcctgcccgatttgcgggtttacgattggtgaaatggagccgcggttattttcgtttaatgcgccatttggagcgtgcccggaatgtgacgggctgggtgtgaagttgactgttgacatggatctggttgtaccggatccaagtatgactttagctcaaggtgccattgccccatggaatccgattagttcgcaatattacccggaactgttggcacaagcggcaactgcctttaaggtgcgaatggatgtaccgtttaaaaaactaaccaagcgcgaacggaatgttgttctcaatggcagcgatggcaagccattccactttcattatgaaaatgacttcggcggtgttcgtgatgttgatgtaccgtttgaaggcgttttgaccaacatttcccggcgttatgccgagacaaatagtgacttcacccggcaacagatgcgcagttatatgacggccttgccttgtccggtttgtcatgggaaacggctcaatcgacaggcactcgcggtcaagatctctggacgtgacatcgctgaagtatctgacttggccattaaggatgcgctgccgtttttcaagcaaatacatttgagcgaagccgagaccgtgattgctcagccaattgtcaaagaagtggtggatcggttaacttttcttgtcaacgtgggcctcggctatttgaccttaagtcgaagcgcggggacgctgtcaggcggtgaagcgcaacgaattcgattggccacacaaatcggttctaatctaagtggtgtgatgtatgtgcttgacgagccatctattgggttgcatcagcgcgacaacgaccgtttaattgcctcgctgaaaaaaatgcgtgatttaggcaacacgctaatcgttgtggagcacgatgaagacacgatgcgtgcagccgattatctaattgatgtaggtcctggcgctggtgagcatggtggccgaatcatggcatcaggaacccccaagcaagtcgcccgcgtgcgtaaatcaattaccggccaatatttatcgggtcgcaagtttatcccggtacccttaaaacgacggccgggcaatggcaaagtgattcggctggaaggtgcgtctgatcacaacttgaagcatatcaatgtcgattttcctttaggtaagttcattgttgtttccggcgtctccggatcaggtaaatcgacgctggttaattcgattttgcggcgggcactggcgcaaaagttaaaccacaattccgaaaaacccgggccatatgataagattctcggctataaaaatatcgagaaactcatcaacattgaccagagtccgattgggcgtacaccgcggagtaatccggcaacgtataccagtgtttttgatgacattcgcggtttgtttgcggaaaccaatgaagccaagttgcggggttataaaaagggacggttcagcttcaatattaaaggcggacgctgcgagaattgtaaaggcgacggcatcatcaagattgaaatgaacttcctgcctgatgtttatgttccgtgtgaagtctgtcatggcaaacgatataattccgaaaccctggaagtcacttacaagggcaagaatattgctgaagttctggatatgaccgttgaagaagcaaccgcattctttaaaaacattcctaagattcgccgtaagttacagacgattgtcgacgtcggattgggttatgtgaagcttggtcagagcgccaccactttatccggcggggaagcacagcggatgaagttggcaagtgaattgcaaaaactatcaacgggtaaaaatttctacattctcgatgaaccaacaacggggttgcacaccgatgatattaagcggttgttggagatcctcgaacggctggtggatgaaggtaacacagtcttggtgatcgagcataatctggatgtcgttaaaacggctgattgggtcattgacctaggaccggaaggcggagatggcggtggtcaagtgattgctaccggtacacctgaagaagttgccgaggtggctgacagttacaccggccagtaccttaaaccggttttaattcgtgataccaaacggacaaaagaagccgcggccggttcgtctaagcaggcaaaagcggctaaaacatcgacgaaatagcatcataaatagtcgcgtgaaaagcgcgactatttatgtacataacaaacgtttggctttctttgagtttgacgaaaaattatccaccgcgacttcaagccggaactttggggtggaagtcagtaaacagccaccttagacactttttaaattgctttttgaaatggtatgattgaaacgattaagaaagtagggaattaaatgttaaatcgaaagagttttggttttgactggggacagtttatcactggtattttattcctgatcgctgcttttgtggttttacgctatccgttagccactttaaaaaccgttacctttatttttgcggtcgtggcgattattcgtggcattgcgattcttgccggttattccaccttgcgccagtttacaggtaagttagcgtggatttccttactgatggggatttttgatctcgttatcgggttggttttcctgttaaatgccggctttggaatggtaacgattaccatgatgtttgcaatttggttcttggttgattctgtcgggtcattatttaacgtcggccatctgcgcattgccggtaccggctggttcattttatatttgatcttggacattctggcagtgattgtttcactgatgttattcatgcagccggttgttgcagcagtcaccttagtcacactgttggcaatgttcttcgtcttattcggaatcgaatgtatcgtgattgcgttcgcccggcggaatatttaatgtttcattagaacctgatgacgtggtgatcaaaccgtggcattgggttttttagtaagcgtgagccagcccggttagaaaccggagtgtaagcggccttggacgtgatggtcgggctttgaccattgcgtccaaggtccttacacgtaggtttctgggctggcgaacgcgttatgggcgtaagctagaatataagcggcctcaggcgtgatggccagtctttggccattgcgcctgaggtccttacacgcagatccctgcgccggggagcgcgttatgggcgtaagctagaatataagtggcctcaagtgtgatggccggtctttgaccattgcgcccaaggtccttacacgcagacttctgcgccggggagcgcgttatggagcgtgaaagccaccgactcacggatcgcaccgctgcaagagaaaagtatgaagcagtatgaatgacacgcccggaatgttatactgtatagaatatgatcacaaaggagccgtttatgactgaaagtttggatcttgttattattaccggaatgtctggcgcaggtaagactgtcgccatgcaagcatttgaggatttggggtacttttgcgttgataatatgccacctgcactattgcctaagttttgggaattggtgaaagaatctggcaagatctcaaaagttgcacttgtcgtggatctgcgcagtcgggctttttacgatcaaatcatcgatatgctggcaaatttagataacaatgcatatgttcattcccgaattttatttttggatgctaccgatgaagaattggtatcccgttataaagaaacccgccgttcccatcccctggcaatggaaggccggttgatggatggcattaaaaaggaacgggtgttattaaccgagctgcgtaatcgtgcgcaagtggtcattgatacgaccactttaagcccgcgacagttacgcgaaaaaatcttcctgaacttcaaagaaaataatagccaaccggcgtttcatattgaagtcatgtcctttggttttaagtacggcttaccgattgatgccgatattgtgatggatgtccggttcttgcctaatccgttttatatcaaggcctatcgcccgaaaaccggcttggatccggacgtttatgattatgtgatggacaacgaagacgcggaaagtttttacaataagttttacgctttgttggccgaaatcatgcctaagtataaggctgaagggaaaaccagcgtgaccattgctattggctgcaccgggggacaacatcgcagcgtagcgtttgcagaacgtattggcaaagccttttccgatgcttatgcggttgacatcacacatcgggacattaagaagcataaggagacggtgaatcgttcatgagtcgtgaaactaaatttattcgggttattcgcggtcggcgtcctaaagttgtcgtgattggcggaggaactggcttaccggtgattttgcatagtttacatgagcaagatgccgatgtgacagcgattgtgacggttgccgatgatggcggttcgtcagggaagattcgcaattatattaatgtggtgccgcctggtgatattcgcaacgttttggttgccttatcggaattgccgagtttgtatctggacatttttcaatatcgctttaatacgactgatgctttttttgccggtcatgcgattggaaatttgattattgcggctttgtcagagatgaaaggcggcatttttccggctgtgcagcagttaagcgagatgatgcaggttgatgggcatgtctatcccgccagcaatacgccgctgaccttgaatgccgagtttactgacggtacaaggttgtccggcgaggcggaaataaccgcagccgggaagaacattaagcatatttccgtgtccgagactgatccggctaatggtgaacccaaagccgtccaagaagtgattgatgcgatcatggatgcggatgtggtcgtgctgggaccaggcagtctgtttaccagtatcttgcccaacttgatgattggtaaccttggggatgcggtgaaaaagaccaaggcagaagtgatctacattgttaatatcatgacgcaaaaaggcgaaacccaaaactttaccgatgccgatcatgttcgcgtcttaaacgagcaaatgggggagaattttgttgatacggtgttggtcaatattgagccggtaccggataattatttggatcaccaaaaatataacgaaattttgacgccggtgaagcataattatcagggactacgggatatgggctgtcgcgtcatttcagaagattttttgaaactgcgcgatcgtggcgttttccatgatggtgataaggtggccaaggagattttgaacttagcctttcaagtaagtgccaaaacgcggaggtgagcgcatggcaagctttgccagtattgtgaaaaaagaactgacgcaactggaagttcatcctgagcatgctaaggcggagctgtcggcattgattcgaatgaacggcagtctaacgttgatggcacatcggtttgtgttgaacattcaaacggagaatcccgccattgcgcggcgtatttatagtctgattcgccaagtgtaccatcacgaagccaacttggtcgttcatcgaaaaatgaagcttaagaagaattaccaatatattgttcgattgacagaaggcgtcaatgatattctgtctgacctggctattttggattcaaccacgatggccatttcaacgactgtgccagccagcgttttaaaggaaccacaacgcatgcgctcgtatttgcgcggcgcctttttggcaagtggctcggtgaataacccggaaacatcgcgctatcatctggaaatctattcattatatgccgatcacaacgcaggtattttaaaaatgatgaatcattttcatctgaatgcgcggaccgttgaacgtcgcagcggctatatcgtttatctaaaagaagcggaaaagattgccgattttttgcaggtcattggcgctaccaatgcgatgcttaaatttgaagatattcgcatcgtgcgcgatatgcggaattccgttaatcggctggtgaattgcgaaacggctaatatgaacaaaaccattgatgctgctcaaaaacagatcgagaacattaattatcttaaagatcatgtcggtttagataatttgccaactaaattacgcgaaattgcagtgttgcggttggcgcatccggatgtgtccttacaagaattaggggcaatggttcctggaggtacgatttcgaagtcgggggtcaatcatcggttgcgcaagttgaaccaaattgctgagggatatcaacaaccagaagatgcttaagccgaatcgatcatataaaaccgttaatgcccgattgaccggtaaaataatacctttgtttcctcaagataatcgtgtacaatgtaaccgacaccaagcgttatggtgtgtgtttttgtaggcaaaatatgtgccggtttagtttaaattcacggacataacgccacacattttgtcaaagcaactttactcacgcatggcagcgattgccgattattttcgacgatatccggaatgttggatgcgacaaagtttgatagtttttgcttcaatttttaggaggaaacatcatggtcaaaccgattacattagatgaacaactgtgttttgcaatttacaaggcacaaaaacaatataaccatttttacgcgcaggcattggcaccgtttaagctgacttatccgcaatatatcaccctgttgtctttatatgaacacggtacgatgtcggttaaacaagtcggacaaacgcttgaactggacagtggtaccttaacgccattgatgaaacggctggagaaagacggttggatcaatcgcaaacgctcaactgaagacgagcgccgagttgatgtgagcctgacgaaaaaggctttggatgcccgcgatcagatttttgaacatgttggctcgtgcatgaaactaatgaatctgccgcagtccgaatatgatcatattaaatccgaagtagcgcgggtggacgaacatttgagtgctatcgctgataatgcctatcccgaagcataaatcttcccaataaggtcaaagattgtgatgaaaatctttgaccttatttgactttagcagtatacttagcactgtactttaaagagtgctaaaaaacgattttttcaggaggttaggacatgctagtacctaccgtcgttgaacaaactagtcgtggcgaacgcgcttacgacatttactcacgtctattaaaagaccggattatcatgttgtccggtgaagtgaacgatcaaatggccaactctgtcattgcacagctgctttttctggatgctcaggattctgaaaaggatatctacctatacatcaatagtcctggtggcgtgatcaccagcggtctggcaatgctagatacgatgaacttcatcaagtccgatgtgcagaccattgcaattgggatggcggcatccatggcctccgtcttattggctggtggcactaaaggcaagcggtttgcattaccgaactcgaccattctgattcatcagccttcaggtggtgcgcaaggtcagcaaaccgaaattgaaattgcggccgaagaaattttgaagactcgcaagaagatgaaccagattttggccgatgcaactggtcaaacggttgagcaaatcaagaaggacaccgaacgtgatcactatatgagcgcgcaggaagccaaagattatggcttgattgatgatattttggtcaataagaacaaccaaaagtaagtttaaagcgtttaaacccaccgaccttcattaggcggtgggtttttgtttggcataaaagcgtttgtaggtttgacagcaggggcctttttggacgttgagcacgtacattaacggtgtaagattgagatgtcgggtttctatgtataattgtgacatgttcagaattgctttcaggccaactcctttgtttataggcagcaacctatgtaaaggtatgaatgctaatggcctaagtcttggcatcgcctccaaagtcgttcattccaaaaaagacttgcaaagttctgattgattgagtaatataattaagtacttgcgcggttagtgtaatggatcgcacgtgagattccggttctcgaaatccgggttcgactcccgggctgcgcagaaacccagtcaaatgggaaaagctaggaacagtaaaagcccgctacggtgggctttttgtttgccggaaaagtagggaaaacgaatttatgtgcaattttatgtgcaatggacctaaaaaagcgtctaaaaaattggttattgcacatgattgcacacacatagctgaatcgactatggtacaagcaatacggcggacacagtgatttaaaaacctaattggtagcgtatgggttgcggctgactcaataatttgagctggaattaaacatggagtgggaagactggaagactccttaatttagtgaaatatctggtggcacccgttatgcgattacaaacaggcttagcgggctttgtcagtaacaagatagttcttcatgaaagccgaccaacaaatacttaatttacaagtgaaaattgctcaaaacagaacatgtctcggtgaaagaagcgcgtgttaggtatattcgggagcctgaaacagtcacacagaaactgcatgaaaatttcattagaacccacccgaaacctgcgttatcaaaaggccgattcagggtcatcgggaaagctaaaaaccgaacacttgaagaattttcgaattagatgttcaaacttagcgggttttgtgattactttaagtcgatttaggcatcagacttgcgataaagcggaacccctgctacaattggttctgttggtaagggaaaacagcaaatgttggattcctaatttttttcagcttgctgggtcggaaaacgactcggagggacgtggaatgacccattaaagaaggacgtgccttatgcatactgaacttgcgtggctcaaagcgatcgcgcctgatctgatgggcgttgtcactaaacgctatcaggtccttcaatttattaactggatggcaccagttggtcgacgaactttagccgaacagatgaagatttcggaacgtgctttgcgtacggaaacggattttttacgcggacaagggcttttggaaagctctaagtccgggatggtgttaacagctaaggggttggaaacttttcatggtctcgatcatctgatgaaccaactactgggcatcaaggatgatgaaaaacgactcgcaactcatttggagattgaccattgtctggtcgtttccggagatgcggatcaaagcagccgagttttagacgaacttggtaaaacgctgaattcaaccttacaattgctgttgccgcccggtcacctgacaattgcggtgatgggcggtacaacgatggctcatttggcttcgcagttgacgtttcaattatctgccggccgtgaactatcatttgttcccgcacgtggcggtctcggtgaggctgtcacgattcaagccaactcgattgcggctgcaatggcagaagcaaccgatagcaaataccgagcgttatatgttcctgaaaacctcagctcggaatcctacgagtcattgattaaagagccatcggtaaaagaggttttaacacttatcgataaagcccaagtcgtgattcatagcgtaggtgatgcacttgttatggcgaaacgccgtggcatgtcacctgatacgatccgcatgttgaaagccaaacatgccgttgccgaagcatttggtgttttctatgatgcagagggcaaggtcgtttacaagataccgcaaatcggattacaacttgcggatcttgatcatattccgtatgtcttcgcagttgcggctggtaaaagtaaagccaaggcaattgcggcgtacatgcaacatgcaccgagtcggacgtggctgttaacagatgtcggtgccacaaactcgattttaactggggcaacccgttagaataaaaccttatttcctaaaggaggaaattttagcatgactgttaagattggtattaatggttttggccgtatcggtcgtttggcattccgtcgtatttacgaattgggtgcaaagagcaatgacatccaggttgttgcgatcaacgatttgaccagcccaaccatgctggctcacttgctgaagtatgattcaacccacggtactttccctggtgaagttagtgcaaccgataacggtattgtcgttgacggtaaagaataccgtgtctacgcagaaccgcaagcccagaacattccttgggttaagaacgacggcgttgactacgttcttgaatgcacaggcttctatacttctgctgaaaagtcacaagctcacttggatgcaggcgcaaagcgtgttctgatttctgccccagctggcaagattaagactatcgtttataacgttaatgatgacaccttgaatgcagacgacaagatcgtttctgcaggttcttgcacgaccaactgcttggcaccaatggcttacttcctgaaccaggaattcggcattgaagttggtaccatgaccaccgttcatgcctacacctcaactcagatgttgcttgacggcccagttcgtggcggcaacctgcgtgctgcacgttcagcagctgctaacacgattcctcacagcactggtgctgctaaggctatcggtttggttatcccagaattgaacggcaagttacagggtcatgcacagcgtgtttctgttgttgacggttccttgaccgaattggtttccatcttgaagaccaagaacgttacggctgaccaagtcaacgaagctatcaagaagcacaccgaaaacaaccctagctttggctggaacgaagacgaaatcgtatcttccgatgttatcggtacgacatacggttcaatcttcgatcctactcagaccgaagttacaactgccggtgactatcaattagttaagacggttgcttggtacgataacgaatatggctttacttgccagatgatccgtaccttgctgaaatttgctactctctaatccggagtaacgcttttctaaccgcaacatccgaagcggagggagctttactccctccgctttttttggaaagaccattaaaaggtgcttttatcagtgtcgctttggcctttgtaaacgagatgttgattgtaagcttaattgaagcatcatctttaggaaaatgaaggaggtcatatcttttggctaaattaatcgtttcagatttagacgttaaagacaaaaaagtcttgattcgcgttgacttcaacgtgccgatcaaagacggcgttatcggtgatgacaatcggatcgtggcagcattgccaaccatccaatatgtcattgatcacggcggcaaggcaattctgctgtctcaccttggccgggttaagaccgaagaagataaggcaaagctgaccttgaagcctgttgcagaacgccttagtgaattgctgaagaagccagtgacatttgtaccagctacccgtggtaaagaattggaagacgcgatcgcaaagttaaatgacggcgacgtacttttgatggaaaatacgcggtttgaagatcttgacggtaaaaaagaatccggcaacgatcctgaactcggcaagtactgggcaagcttaggcgacttgtttgtcaatgatgcctttggtaccgctcaccgtaagcatgcttctaacgttggtattgcctccaacatgaaacaaactgctgccggcttcttgatggaaaaagaaatcaagttcttgggtgacgctgtggacaatccaaagcatccattcatcgcaattttgggcggtgctaaggtttccgataagatcggtgtgattgaaaacctggttcctaaagctgacaagattctcatcggcggcggcatgacttataccttctatgctgccaagggtatgagcatcggtaattcactggttgaaaaggacaagatcgacttagctaagaagatcatggaccaagccggtgacaagctgcttttgcctgttgattctgtggttgccccagaattttctaacgatgcaccgcataaggttgttgaaggcgacattccggatggctacatggcgttggatattggccctaagacgattcaggaattcaaggatgcacttaagggtgccaagacggttgtctggaacggcccaatgggtgtctttgaaatgagtaactatgctgaaggtacacttgaagttggtcgtgctcttggtgatttgaaggatgcaactacgatcatcggtggcggcgactcaacagctgcagctaagcaacttggcattgcacctaagattacccacatctccactggtggcggtgctagccttgaataccttgaaggcaagaccttaccaggtattgcagccatttctgacaagtaattgttagtgatgctgatctaacagtcgttatcgacatgcaagatgcatgtcggtacataatgaaaggaagctatgtcatgcggacaccattcattgctggtaactggaaaatgaataagaatcctaaggagacgcaagccttcttagatgctgttaagggtaagttacctgatgcaagcaaagttgaaacagtcattggcgcacctgccattgatctaacgacgctggttgccggtgcagaaggtactcctttgaagacagcggcggaaaactgctactttgaagacgaaggtgcttttaccggcgaaaccagcccgaaagccttaaaagaaatgggcgttgattacgtcattatcggtcacagtgaacgtcgcggttatttccacgaaaccgacgaagatatcaacaagaaggctaaggccatctttaagaacaatcttttgccgattatctgctgtggtgaaagtttggctcagcgtgaagccggtcaaaccgaagattgggttgcttctcaaatcgaagcagctttggcaggcttaagtgccgaccaagttaaggtttcggttttggcttacgaaccaatctgggctatcggcactggtaaaacagcaactgcagatcaagcacaagaagttgttgctcacatccgtgcaaccgttgagaagttgtataataaagatacggcagatgctgttcggattctttacggcggctctgttaaaccagcgaacgtcaaggaattaatggctaagcctgatattgatggtggcttagttggtggcgcttcgatggatcctgacagtttcatcgccttggctaactaccaagattaatctggtttcaatattaaacagccttctggcaaaaaggagaagaatatatgtctatcattactgatgtattggcacgcgaagttttagactcacgtggcaaccctactgttgaagttgaattgtataccgaagatggcggtttcggccgcgcattagttccatcaggtgcttcaaccggtgaacatgaagccgttgaattgcgtgatggcgataaggatcgttttggcggcaagggtgttttgaaggccgttgaccacgtaaacaatgaaattgctaaggctgtgattggccttgacgtcaccgaacaacgcttgattgaccaaaccatgatcgatcttgatggcacgcctaataaaggcaagctcggtgccaatgcgatcttgggtgtttccttggctgctgcccgtgctgcggctgatgaagttggtctgccattgtatcaatatcttggcggcccgaatgctcatgttttgccaacgccaatgatgaacgttcttaatggtggtgcacattcaactaacaccgttgacttccaggaattcatgatcatgcctgttggtgccaagagtgttcgtgaagccgttcggatgggttcagaaaccttccacgcattgcaggcactgctcaagagcaagggtgacatcactgctgttggtgatgaaggcggctttgcacctaacttgaaggataacgaagaagctttcgaattgcttgttgaagcgatcaagaaagctggctacaagccgggtgatgacattgctttagccttcgacgttgctgcttcagaaatgtacgatgctgataccaagacgtacacaaccaagtggtccaacccagacaagaagtacacaaccgaagaatggaccaacatgattgacggctacattaacaagtatccgatcgtttctgttgaagatccaatcgatgaaaacgactgggaaggttggcagacattcaccgagaagatgggcgacaaagtccaaatcgttggtgatgacctgtttgttaccaacaccgattacctgaagaagggtattgacatgggtgttgctaactccatcctgatcaagttgaaccaaatcggtacattgacagaaaccttcgaagcaatcgaaatggccaaagaagctggttacacggctgttgtttcacatcgttccggtgaaaccgaagataccacgattgctgacttggttgttgcaactaacgccggtgaaatcaagactggttcaatgagccggactgaccggattgccaagtacaatcagttgatgcgcatcgaagatcaattaggtgctcaatcacaatacaagggtcgcaagtccttctacaacgttaaagcaattgactaattaacgcttgacgttaacatgaaaagcacgtcacttcaaatggtggcgtgttttttctattcttagcttaagcaaaagatgaacttgctcacgcgttgtgactgagaactgtgtggtgccggtgcaagtacctatgtctgagcattactaaaacgaatggaggcaatgatgagaaagttttttgcaatttttgcttggcttgagattattttaggcctagccatgctgtggatgacctttgatgttggattgcgagctacaggaccttttttcggcgccttaatcgtcttaattggcatcgtattgctatatggcttattgatctatgcgcttgtcgggtggtttattgatcggcaacattggccgtggtatgtggtaacactagtcgttaccttgatctataacgtgttagcgtggtctttccctaaaatcatggtgcaacgctgggctacgtatccttttccgatgttgacgctgatactcggttgtttgatggcgtggattgcttggcgtgagcagagcgtaacgcacaagtcggtgtagaaaccgggctggttcacgctttccaaaacgcgttcaccggcgcagtagtcttgcgtgtaagggtctcgaacgcaattggccaaagcccggccatcacgcccaaggccgcttacactccgatccctaggcgcgctggttcaggctttccaaaacgcgttcgcagtcgcagcaatctacgtgtaaggacctcaagcctcaatggccaaagcccagccattgaggcttgaggccacttacactccgattgctaagcgctcctgctcacgctctaaaaatgatgtttttcacgtttccctcaaagggttatactaaataaatgttggcatggagggaagcattttggcacgaacggtaaaagaaaaagaaaaatttgatatcacccggctgcggtttgtcttgctgggattgcttgtaggtttaatgaccggaacagttgtcagtgcgtttcgttattgtattgaagttggcttacgcgccagtcgtcaggtgtacggttatttgcgcgtaacaccgtttgtttggtggcattgggcgttgttaatcggctttaacctagtgcttgctggtattgttgcgtggctgcttaaaaaggaaccgtatatttctggctcagggatcccacaggtagaaggacaacttgccggtgagttggaaatgaattggtggtcgattctttggcgcaagtttgtcggcggggttttggcgcttgctcccggtttgtttcttggacgtgaagggccttcgattcagttaggtgcatcagtcgggcaaggcttggcaggcgggtttaaactgcgcggcactgatcgacggttgctgattgcatctggatcggctgctggtttggcggcggcgtttaatgcaccgattgccggtaccttgtttgtgctagaagaggtttatcataacttctcgccactggtttggctgactgccttggccggggcgattggttcggactttatttcgttaaatgtgtttggactagtgccggtcttgcatttgagttattcgcgcagtttaccggttacgagttactggcatttgattttattagggattttgttaggtttgctgggttatttgtatcagcgagtgttactagccatgccccgttggtatcagcgattgacacacttgccgcgtgcaatccaaggtgttgtcccatttgtgctcttaatggcggtcggttacttcacaccgaatcttcttggtggtggtaatagtttgattgttggttttggccaatatgtgccatcacttctggtgttattgggtatttttgtgattcgctttatcttttccatgatttcttacggttcagggttacccggcggtatttttctacctattttgtcactgggggcggtgattggcgcggtttatggcgtggtgatgaatcagctagggttattgccgcatgtttatatcatgaatttgattattttctcgatggccgggtactttgccggtatcgggaaggcgccgtttacggcaatcttgttagtaaccgagatggtgggcaacttaacgcatctcatgccccttgctgttttatcactgactgcgtatctggtggttgatctgcttggtggggcaccgatttatgaagccttgctggaacagatgacgattcctaaaaccgtcgctcaactgcaccggcctgatcgtttggaaattccggtattcgttggtagttcgttaaatggcaaactggttcgtgacatgccttggccaaaagaagccttgctcatcggcattcggcgtggcgagcgtgaagttattcctcatggggacacgttgatccgtgaaggcgatacattggtattgttgacggatgaggcacaacgagcacgagtaaagcgccgaatagatgctttttcagcagccttggcaaccgcgcataagtctgaaccatagtcaattagggcggagctttttcaagttggtttagtcatttcaggcgtatacttgtacctagcaaagacgtaccgacttgcaatagaaaggttttgattagtatgaaaaaacttcgcattgtatatgcaattgtcagtattttcttaggcctgttttattcaatcggcggagaactaggtttgcttacgtcatctggtagtggcgttgcgagctttctggtgccatttttgttgggctttgttgctaattggggcatgattgcgttggtcattgcaggattaattgttgataagcagatgcgctggtggtatctggggtatccggctttgatgggaattaacattggcctgaacctgatattaccgttgcagcttgctgatcaggcgagttatttggctccttttcttgttgcgattattggcggatatatgttgtatcgaacggttaagcaacgtcctgatgccgcttaaatctttcgtcagtgtacatgattttgtcaggtttgaagtgtaaatggcggttaaaatatccggctgacggctataagaacaaaatcgggtaaaattcgcctttgccttgcttttatgctaaactactaaagtgagatttttcgcaagggaggcagcaacttgcaaagtttattgaccacattattagtgatcgattcggttttgatcgtgatcgcaactttaatgcaaccaagcaaacaacaggacgcgttaagcgcattgtccggtggagcaacagatctttttgggaagacgaaatcgcgcggttttgaagcgtttatggagaaagtcaccgtcgtactgggtgtcattttctttgggcttgccatcgcgctggtttatctggaagcccactaaaacaaagtctcctggaacattcaggagactttttttgcagagtacataaaatctgcagtatgctgacataaccatttaatttaagctctttatgtcgggcagggcaacaggcagttatcggttggcggtcttttaggattgcttactaatcgattgtcacgaaggatgattgatcatgattttccgcaaaccacaaccattcgaatatgaaggtaccgatactggcgtggtattgttacatgcatacacgggtagccccaatgatatgaattttatggcgcgggccttgcagcgagccggttatggggtttatgttccgcttttttccgggcatgggacagtggagccgttagatattttgacaaaaggcaacccggatatttggtgggcagaaagtagtgccgcggttgcgcatatgaccgcaaaatacgccaaggtgtatgtttttggcttatcactgggaggtattttcgcgatgaaggcgctagaaaccttgccagggattacagcaggcggtgttttttcatccccgattttgccgggcaaacatcacttagtaccgggttttttaaagtatgccaagtatatgaatcggttagcaggcaaatcagatgaaagcacacagattctggcatatttgccgggacagttggccgcaatcgatcagtttgccacgacggttgctgctgatttaaatttagtcaaacagccgacttttattggacaagccggtcaggatgaattagttgatggtcgattagcgtatcaattacgcgatgccttaatcaatgctgcacgcgttgattttcattggtatgatgatgccaagcatgtcattaccgttaactcggcccatcacgcattagaagaagacgtaatcgcatttatgcaacaagaaaacgagggatagcatgaccacagttggccatattcgtaatgaactattagcaacatttcgtaagaatccgaacattgattattcggttcaaacactcagtcgcgcacttaagttaagtgaaggcggcgattttaaagtactcgtccaggcgttaaacggtatggaaaatgataacctgattcacgccaatcacgaaggacgttatgcattgggcggcgcgcctaaagtcttgaccggcactttccgcggcaacgaaaaaggctttggcttcgtggcagttgagggcttggacaatgatgtttatgtaccggcgatgaacaccgattttgcgcttgatggcgataccgttgaagtgcggatcgttcgtgaagcccgtcccaatgatagtcgcggacctgaaggcgaaatcactaagattgtgcagcgcagtttaaccacactggttggtgaattcaaaccattttccgataaagatcgggctaagtctggatttatcggaatggtggttagtcatgaaaagaaactgaagaattttccggtttatgttaaagataccggtaatattccgcaactcggcgatatgacggtgacggagattactgaatttccaaccgaatatcatcccaagttgatgtatgggatcgttgtcgagacgttaggcaacaagaatgatcctggcgttgatattatgtcactggtcatgcaaaaccatatcaaaacggaatttccggatgaagtgatggatcagaccaatgccattcccgatcatgttacgccagaagaacgagttggtcgcaaagatattaccgatcaggctgttgtcacgattgacggggatgacagtaaagactttgacgatgccgtggtggtttggaaattaccaaatggaaacttccatcttggggttcacattgccgatgtttcgcattatgtgacggaaggctctgcgttggatcaagaagcatttgatcgtggtaccagtacgtacttggttgatcgcgtcattccaatgctgccatttcgactatccaatggcatttgttcgttaaatccaggcgtggatcgattggcaatgtcgtgtgatatggaaatcgatcatgatggtcatgtcgtaaaccacgagatttatcaaagtgtgatcaagagtcatgcccggatgacctacaacaatgtgaataaaatcgtgaccgattacgacccggaagtcatggccgaatatcaagaactggtacccatgtttgaagacatggttgaattgcatcagatcttgtataaaatgcgtcatgctcgcggtgccattgattttgaagaaaacgaagccaaaatcattgtggatgatatgggtcatccaactgacattgtgttgcgcgaacgcggcgtttcagaacgcatgattgaatccttcatgttggcagcaaatgaaaccgtggctgagcactacaacaagcagcatttaccatttctctatcgagtacatgaaaccccggatgcagatcgcgtcaaggaattcatggagttcattgccagtttcgggatcacggtaccgatgaaaaagggtaaagagatcactcctaaacaactgcaagatgttgtgaccgatgtaactggcacgccagaagaagccatggtcaatgttaaattattgcggagcttgaaacaggcccggtactcaccagatccgctggggcattttggcttagcggcaaaatactattgtcacttcacaagcccgatccggcgttaccctgacttggttgtgcaccgcttgattcgggattacgcgctggaaggcactaccgatgacgtgaagacgtcttggaataagaagctgcctgatattgcgacccaagcatcgatggccgaacgtcgcagcattgatgccgagcgtgccgttgatgacctgaagaaagctgaatacatggctgataaggttggcgaagaatttgatgccgttgtcagtggcgtcacgagcttcggtatgtttgtggcactgccaaatactgttgaaggcttggttcacatcacacgaatgagcgatgattactattcgtttgtcgaaagtcaaatggccttagtcggtgaacgtaccaagcggacttatcgaatcgggcaatcgttgcgggtgaaattagacaatgtggacatcgatcagcggcaagttgacttttcactgattccagacgaaaaaacgccaaccagcgatttaggcaagttggttaaaaaagatgatcgccgtgatcgacgctcaaatggcagtcgcccgagcttcggtaacaatggtcgtggtggcaatcgtaatcagcccaataatcaacgaccacataagccagcaggtgcgcctcatcaaggtaaacattataacgccaagcgcgggactaagtaacgctggcaacttttaaatatacgaggggatggttcaatggcgaagaaacatcgacaaaaacctgacaacctgctcgcccagaataaaaaggccggtcatgattacaacattcttgatacctatgaggctggtattgctttgacaggtaccgagattaaatctgtgcgcgatggcaagctcaatttgcgtgatggctttgcccgtattcgcaacaacgaggcttggcttgaaaatgtgcgtatcagtccttacaaagaaggcaatttgtttaacgttgatccgatgcgtaaccgtaaactgttgctgcataaaaaagaaattcgcaagctcggtcaaatgacggcgcgccaaggagttactttggttccgttgcggatgtatcttaaacacggttatgccaaagtgttgatcggcgttgcggaaggtaagcacaactatgataagcgcgaaaccttgaagcgtaaggatcaagagcgtgaggttcagcgggcattaaaagctcggtattaataaaatttgcgccagcatgaagcctgtttggcagatgagtgttggtgtaacacaaataggcattagcggtcagagatgacgctgatgcctatttattttgtcctgagcgtggcagcctcattcaatgatcaaggtcatcgggccctgacaccttgtatgatgccctatgatgaatcgccaatagacttttgtgattgtagcctaaatgacattaaacgatgatcagttaagcggagggtaaacacgctgatgcgaattgtttgagcgcctgatatgaaggcggtatgatcgctgtatagatactgttttttggcaggattttgttacttatgaagaaagaagggcggattatgaacttagctgctttgttgcatcgcccggaaagtgaagattgttttttatatacggatgaggcaatgcgtgtgcgatttcacacggcacgtgccgatgttgcgaaggtgacggttctgtatggcgatccttattggcaactgcctgatgcagatggcactaataagttgatttatcagcgccggtcgatgcatttgataggtcacgggcaaactagggatcactgggaggtgacactcgaagctccttatcaccgcctgcaatatttatttgaggttaccggccaagatggcgctgtgtggttgtatggtgatcgcggcgttcgagaaaatcacgcggcagcacgacataaggcggaaaactattttcggatgccgtattttcatgcaattgatcgggttaaaacgcctgattgggttaaacagacagtttggtaccagatttttccagaacgctttgccaacggggatcccgataatgatccgattggaaccaagccgtggcggccaacggatcatcccgggcgcgaggattattacggcggtgatttacaaggggtattggaccaccttgacgatttacaggcgcttggtatcaatgggctgtatttttgcccgattttcacggctgcttccaatcacaagtacgatacgattgattatttgaatgtggaccccgcgtttggcgataaacttttgttcgcgaaattgattcaggcggctcaccaacgcgggatgcgagtcatgcttgacgcggtgttcaatcatatgggctttggcagtatgcagtggcaagatgttttacgcaacggagaagcatcgcggtttgcgtcttggtttcacatctatcaaacaccagtcacaccgtttcacaatcctctcaagaatgccggccaaccgcagtatgatacctttgcatttgaagaaaagatgcctaaattgaacactgccaatcctgaagttcaagaatatttattaacagttgccacttactggatcaagatatttgatattgatgcgtggcggttagatgttgccaatgaagtcgatcatcatttctggaaaaggttttacgccacggtaaccgcgattaagccggacttttatgtgttaggtgaagtctggcatcgcgcgcagccatggttaaacggggatgaattttccggggtcatgaactatcccttcacgcagcagattgaggatcactttttcaagcgaacattgaccgctgaagaaatggtggcgctgttaaccgatcaactcatgtactatcgcgatcaaaccaatcaggtcatgttgaacatgctggattcgcatgatacaccgcgcatcctgacgctggcgcatggtgatgaagccctggcactgcaggcgttgacgtttacctttatgcagactggtgcgccatgcttgtattatggtaccgagatgggcatgtcgggtggcgatgatccggatgaccgcaagccgatggactggagcaaacttggcagcccgatttggaaaaaggtggtggagctggtacactttcgccgggaacacgcacagacattaggccaaggcagtacgaggatgtcggtgactgcggccggcctgataaaagtgacccgccatggcgatgaaatgttgacggcttactttaatacgcaggatcatggagcagccgttgatggcagtgctgttttggcgcaaggttttacgaatggcaagttgtcgccaaaaggatttatggtacaagtgggtaaccagtgaggagcatcagggtttgtgtatgaaacgagacctacctgtgcaaagggctacgtgccataacgcgcttaccggtacaggtttctactcgcgccagtaagcgtttattttcttttagtggggggattaaaagtgaagcgattattcgaagtcgatccttggttagtggcaacacatcgtttagagacgacagatcgccggctgcaagagagtatcaccgcggtaggcaatggttatatgggcctgcgcgggaattttgaggaaggctacagcggcgatggtttgcaggggacgtatttaggcggcgtctggtttccggataaaacgcgcgttggttggtggaagaacggttatcccgagtattttggcaaggtgattaatgcacctagttttctggggattgggataacggttaatggtcaacaggtggacttagccaaaagccattaccgcgacttttatctggcattggatctgcatcaagggctgttgacacggcggtttgtttatatcggcgctgatgtggaagttcagtttgagtttgcccgctttttaagccagacgataccagaggcggctttgatcaccgtgaatgcaaccgttttaaaaggaaccgccacgatcacttttgacgctaccttagatgggcgggtgacaaatgaagacagcaactatgatgagcggttttgggtggcgcagcatgaggatgcaacggctaaaagcattcaactgcaaacaaaaccgaatccatacgctgtcccgcagttcaccgtattacttaagcaacaattacgcgtgaatgggcaggcaattgtcggcaaagtcacaactgctagtgggtggcttcaggagcaggtcacaacgcatttaacaacaggcgagcactatcagctggaaaaagatgtggtggtcgtgacaagtcgtgatattgcccctgacgatcaagccacaaaagctacccagctgatgaaccgagtcgtcaaggatgatttcaagacccatttagcagctcacacgcaacgttgggctcagcgctgggctaaaagtgatgtcgtcattgatggtgatccggccgcgcagcaagggattcggtttaacatcgcgcaattatttatgacctactatggtgaagataaacgcctcaatatcgggccaaagggatttaccggtgaaaaatatggcggtgcgacttattgggacaccgaagcttttatcgtgccgatgtatttagccgtgaccccgccggaagtgacccgcgcgctgctgcagtatcggcatgatcagttaccgggtgcttatcacaatgcgcgtcagcaaggcttggccggcgcgttatatcccatggtgacgtttaacgggattgaatgtcacaacgaatgggagattacttttgaagaaattcatcgaaatgcggcgattgcatttgcaatttatcaatatacggcttataccggcgacgaaagctatgtgaaccacgatgggctcgaagtattggtcggcattgcccgcttttgggctgatcgggtgcactttagccagcacgcccaaaagtatatgattcacggggtcactggccctaatgagtacgaaaataacgtcaataacaattggtacaccaataccatggctgtgtgggagttgcagtatacgctggcacagttacctaaaggcgatcctgatattgtggcggcattggcagtaacagatcaggaaaagcggcattggcaggcgattattgaccagatgtattatcccactgacaagaaattgggaatttttgtgcaacaagacggctttttagataaggatatacggccggcaagtacgattccggaaacacagcgcccgattaatcagcattggtcatgggatcgaattttgcgttcaccgtttattaagcaggccgatgttttacaaggattgtattttttaaacgaccggttttcgcacgcggaaaaagaacggaattttgatttctatgagcccttaaccgtccatgaaagctcacttagtccgtccattcacgctattttggcggcggaacttggcaaaatggatacggccgttgccttgtatgcgcgtacggcccggctcgatctggatgattataatcacgatactcaagatgggttgcatattacatccatgagcgggagttggcttgcgattgttcaaggatttgccggtatgcgctatgaccatgaccgtttgcgctttcggccacaattgccgaaaaattggcagcggtatcaatttaagctgacttatcgtggtcggctgttagcagttgacgttggccaaaaagtaacggtcacattacttgctggcccgccgatcgatcttgatatcaatggcgaaacgcagcacttggaggtggaggatgaccatgcttaagggattcatttttgatttggatggggttttaaccgacacagccacttatcatctggccgcttggcacgaactggcgcagcgcctcggcattcacttgccagctgcagccgatacggcgttgcgcggccgctcgcggatggactcgctgaatctgatcctgcgttatggtcatcaagaaaatgactacgatgaggcacaaaaagccgccttagccgcagaaaagaatcagcgttaccaaacgttcattcaatcactgacgtctgcggatattttaccgggaataccatcactgttgaaaaatgccaagcagcaggggttaaaattggcgattgcctcggcgtccaaaaatgctccgttgattttacggcggttgggattattcgcgcaattcgatgcgattgtcgatccgcaaagtctacaccatggcaaaccggatccggaaatttatcgcgcggcgcaggaattgctgaagttgcaagccgacgaggtcattagttttgaagacgcaccggttggcatcgcggcgattaaagcagccggccagtttgcagtcggcatcggggaggcttcggcattggcggcggccgattatttggttagcaatacagcccagcttgattacgatcaaattgtcgcggcgtttgagcggtatcatgcgcggtaatcagcaacgtcacgctaagttgatacggatattgataggtcaaaaatcatgtgctgaaaagtaaaaacattttgacatttctttcgctggcgttatactaatcatgtcaaaaggatttgacatttaaggggtgagagccatgaagaaaatggatgaaatggagcggaattttgccgatcactcgataagaattgcttacatgatgatgtttctaatgttatggtcaagtgcggtttttcagcatattcgtacaggagcgtggaatttcgatttctttgtggttaacgtggtgacggttgttcaaattgccagctatgagtggttcaaacaccgagctgattcaactgacaaggagccgggacgagttttgtacatgaccatcgcaggggtggcgattgttcttgctgttggcgtgctcgccttgatgcgtcatggaaaataagattcgcacccttagaacccagcagcacctgacgcaacaggaattagctgatgcagtcaatgttacgcggcaaacgatcaatgccatcgaaaacaataagtatgatcccacgttgtccttagcatttgcgttagccaggcagttacagacaaccgttgatcatctctttcaaagttaaaagcaggctgtccacgtcaacaacgtgaatagcctgctttttagatagatcaatcatcatcttctccgagcgcatcgaagtcataataaagatcacgttcgggtaagacaacatctgcatttgtttccgcgtcaatcgcctcagcttcacgttccgggtgaaagctatgccacggcacgatcacccgggggttcacttctttagccaacgtgattaagtcttcgcgagttgcatggccggaagcattcataaactgcaaaggaatttgatggtccgccaaccaatccttcagctgagcaaaccgcggatcgtaatcccccaaaggttcaccgttactgtgtacataagcgctgattggtaagtctgccaaccgctcaaggtgcgcgtaactattttgcagaacatattgttgaggcgcctgtgcaaggtcagttaactggattgttttgccaagaatcgcatcaggctgctggttggtcattgcagttaaaattgccgcttcgttaggctcccacaccaactgacgcccacttgcatgcgctgaagcttggaaggctgccatccgctcataattgcgattgtaagggttgatgacgaccagctgtgggctgtcagttagcaattgccggaatttggtttgcaggctcatttcggtcagtggcacacttggatgatcctgatcttcaaccggtgtcggtgtatcaaacgaaaagctagtgccttcaagcatgaagagactgatcttttcagcattgaaacggctagcccaggcgtgcacacgatcagcatgcgggccattgaggcgaacgtccccggaatgggcaaagcggcgcgcaccatcatcaatcaacagcgccatcaccccgggttcatcgtgatcgctgtgaaatccggttactgtcaaatcgccaattgccagtggcgtttcaaaggctaaggaatggagattggcaaccggtttttcgatgcctaagcgaatgagcacctgatagaggcgataggatggttcagaaagatagatcggaatgtttttctgcaaatattgtaaggcacccatatgatcaatatgcaggtgcgagatgaagatggcttcattggtaaacgaatccggttgatcgaaaaaaagttccgggacatgcggtagtttgccgttatcaatggccgaggcaaccgtttcatggcttaaatcagctgcaaccccaaaatccatgatgacccggctggttttggtggcaaattcgacaatgttgccaccaatggtattgagaccgtttaaaaagcgaatcgtcgtcacaataatttcctccaatgtctctcgttggcattcgcgagaacattaaatcgtaccccggatatgcgtgaaaagcaactattaaagtgaacccgacggcgtcaactttttgtgggtttaacttgtaaactttttgctagaatgctttttcaacttacaactgatgtgtgataccgtattgccagccgcgatgtttcccactagcgagttctacaaacgctgcttgcgccgcttgtgagtatttcgtggctgctgatttaaactgaatcttaatacgatcatcaacgcgaatatcaatctttgtttggtgacgttccttggcttcggcttctaaccgctcaaaaacgtttccgcccttaagcacgtatacccgcgtctgtgataaattgtctgtgccagtttgtgaccagcccattggccgcgaactgaagcgctctgaaagcatatgactaatatgaccttcagctgatgtcccgtgaaagtctggatcattgttggcctgaatttgtttccaattcttgtgaatgagcgttcgtgcttgtcggacagctttgcgttctgacgaccgtaactgagggtcattgagccgaacacggaaataatcatttagatagcttgagtgcccttgtaacgcccaatgcatgagaatatcgcccagattaccgggtacgccaattgccgcttgtttgcacgctttacgtaggtgaaatttatcgtagaccaccgtgcagttgggtagaaaatcggccccggttttgatccaactggcaccatcaccggccagaaaaaagcgtttgggcatctgaccgccatattgtttcatgatgcaatcaagcgtggtttgccagatttcttcagtaccagctgttcccgggtattcaccggtaatataaaatggcctaatcaactgaaacttcttacccacagaccgataaccttcatgtacataaaccattttcaagaaatgattggtgccgtcctgatgggggacatgatcttcatcggcttcgacaaataatgtttccggtacgggcattggttgatcctttaactgatccaaagcgctgatggccttcccgtctctatgaacaacatgcatgacggtgctcttcgatggttttgtacccccgccgttacgatctcctgattgcttgtaagacatttgggcggcatcttccagcagcttagctttgaggtcgagcgaaagtcggctacgcttctcaataccaacgagttcatcaagcaagaagacacgctcgccagtccgtttatcttgataataacgtcgggtgaaaaccagtgagccaatggatgccaagtaagtgcgttcccgcttatctttgacgctatagaatcgacggcggtaagcactgtccataatagcttggtccacttgttccagtgcctgcccaactaactggcagaggtgctcacgaaagttttcctgattggttaaaatgaattgacttaaatccagcttgcccgcgaccatctccatgacagattcatcaatttctttcaacatttctaaaatgatttgttgtactataggtgacaagagcgaattcctcctactgctatcgtgtttttcttgcaattaacattctagcacgaagggattcgctccctttttgtttgctcagatatcacccacttaaactttacgccatggtgaacccggaaattaaaatcagcctcagagacagtttcgtctctggggctgattcagtgtcgtgctggtatgacaagtcataatttggcataccaacctagtagtttttggttatttgtttgtcttgataattgtttctgcctgactttgcagcgtcttcaaagcttggtctggtttttcgtgtttcgtcagcatagcatcaaccgcgttcagaagatcgttgcgatattccgagaagccgatgaaggcagtggattggaaaccgaagccgagtgaatcaacggctgctttgctggttggattatcactgagatatttcttgaagtcagctgattgaaccgcggatttacgcagcggaacataaccggttaattgtgcccacttggaagtttccttttcagatagcaggaacttcatgaatgcccaagcacctttttgctgatcagtagaagcggatttgaagaggacaatatcgttgccggccagttcagttgctttcttacccttgtaacttggtagtggcatggtgccccacttaaagtctttaggcgcattttgcttcatgttggtgatgccggcactggagcccgcgtagaagagcgttttgccggaagtgaagttcttatcgccataaatatcttcaccagcggttttagcctcgccgttgttcaccatatccatgatgaagttggctgcggttaaagtcttcttgctgtccaggtttgccttcagcgggttagcagaaacaagcggattgcctgcttggcgtgcaagtccttcgaattccatatcgaaactcttgtcaaagccaattgccgcaacgccgtcagccttgagcttctcggcatccttcttaatgtcttcccagctctttggcttatcgatgttgtacttcttcatcagtgcttcattataaaagagaatccgcgttgacttggagaatggcacgctatagtacttgccttggtacttggagctagacaagaaggctgggtagatatccttcaagtcgctattgctcattttgtcatcacctttaagcatgtattgatcaagcggggtgatgaaaccatttttcacataatcaggaacggtggtgtaggttgtctgcgcaattgtcgggagattacgcgactttgcggcagccataatcttttgctgcaacgcggtgtaattgccttgcgcagtgccgacaactttatactgcttttggctcttgttgaagtccgtgatgatctgattaagcgccttttgataaggaccgttcatcccatgccaaaaggtgatcgtcacacgtttacccgaatcgctcttagtcgtggaactggatttgctgctactgttgctgccgcatgcggttaagatggcaaccaacatgaccgtaaacattgcaagtaatgcttttacccaagtttgctttttcattttgatagattatcctttcaatccagctttagaaatcccagcaataatgtacttctgcaagaagatatacaaaataaccattggaatgatgacgaatgtggaagccgccatcaaaagttgatattgtgtgccggcatcagttgtgaaggcctgtaagccgactggcaaggtgcgcattttgtcggagtttgtgacgatcaaaggccacatgaatgcgttccatgacccgatcacctgaaggacggtaaccgctgtgatcgtggacttgctcattggaacgagcacctgccatagatacttccaatccgatgccccgtcgattttggcggcataataaatctgatccggcgtcgattggaaagtttgacgcaacgtgaagacggtaaagaagctggccagccacggaagaatcagcgctccgtagtggtcgatttgtcctaagtgcgacaaggtgacgaaattggggatgatcaacatttcaccaggaatcatcatggttcccaagaaaatgataaacagaatattcttgccatagaacttcaaccgtgaaaaagcgaaagcagcaagaatactggtgaaaagctgtccaaccgtggtcaccaccgttacgatgatactgttgatgaaatactgaccaaacggcgcttcattccatgccttaacatagttgctccactgcaaggcttttggaatccaaattggtggaacggcgattgtttccggtgcggttttcagtgatgtcgaaatcatccatagaaaggggatcagcatggtgatggcccctaaaatgacgatcagataaagtaagactttactgagcttttttgccatagtttgcttttcccccttaataatgaacgtgcttgcgcgaataccacagctgcacgagcgtcacgagcaagatgaggaagaaaagcacaacgccggatgcggccgcaatcggatacttatactcggtgtaaaatttctggtacaagtagtacacaatcgttaaatcggccttgcctggtcccggcgtcccttggaataaggcaaagatttcatcaaacactttgaaactgccgataatcccgttaacggaaaccaagaaagtgatcggtgaaagcatcggaatcgtgatgttccaaaatcgctgacgagcattggccccatcaatttcagcagcttcgtaataaccgtggtcgatgttgtttaagccaaccaggaaaaggatgatgttgaagcccaaacttttccagatactcatgatgatcagtgccaacaaggcgtagtgcggatcagtcaaccagttaatcggatgaagtccaaaccagctcatgaagtaattgatcaagccgtaattaccatggaacatccaattccagaccatcgcaatcgcaaccgtacttgtgacgaatggtaagaaatacacggttcggaaaaaaccggaaatgatctttacctgattaagcagcaaagcaatgattaatgacaaaacaaccgttatcgggacaaccccgatgacaaaaaccaaggtgttgcgcactgccaaatgaaaatcaggatcattccagagatagacaaaattgtcaaagccccagccgctgaccttatccgtgtaaaaatcatacttggtgtacagactcattaaaaaggaattaatgatcggccagatattgaaggtgatggtaatgacgagcattggcagtaaatagagtgctgctttagccgtcgatttgagcgtggctttttcattcagcatgactttcaccaccaaaaatcaaggcgccagactgatcaaagagaaaaaatcctgatttagtgatgtaaaaatccaactccggctgacgactggaaacgccagccatttcggtagacagaagccgctcgccgttataatcaatatcggcagtcgcctcacgtccatatttggaactatgcgtgatcttgccatggaacttggcaaggacattttcgccagcatcataagggataatggcttcactacgaatgccggcagtgacagcttgtttcaaaatcgcctctggtaccgcattagctaaatcagctgataatgcctgtgccgggatcgtgttaataacaggttcgccgataaacttagcaacgaacaggttgttaggctgatcgtagagggtctgtggcgaactaaactgctgaatggacccgtttgcaagcaccataatgttgtcggaaatatgcagggcttcgtcttgatcatgggtgacgaaaatggtggtgacgccggtttcacgttgaatccggcgaatttcttcacgcatctcgattcgtaaccgcgcgtcaaggttggacagtggttcgtcaagcagcaaaagacttggcgatttggctaacgcgcgcgcaatggcgactcgctgctgttgaccaccggataaagctcccggttttttgtcaagctggtcttcaacgtgcaccaatttggcaaggtctttagctttggcgtggcgctcggcttttccgactttagccatcttcagtggaaaggcaatattgtccaagaccgacaagtgcggatacagactgtagttctgaaataccatgccgactttacgggctaaggcatcttttttagtgacatccgtatcaccaaagaaaatttgcccggcagttggcgccaacagtcccgaaatcaaattcagtgtcgtggtcttaccgccgccggaaggacccagcagggaaaccagcgtgccatcgggaatggtaaaattcagatccttcagggtatctttcttgccatcgtaggacatcgtgacgtccttgaaagtaactttcaacccagtacgctccttcgaatagttttctgctcctcacctccgttcgtcggtcccacgcaaacatgccggtggggtcgcgccaaaaagaaaatttggaacaagatattgtggtgccgccacttcactaaagcatatctagggggcggggcgacaacacaactcttcacatattttaacccagtttcactcaaaattggactcattcgcttaaaaacatttgattgttacacaacaagcgataagacgcgaacgttcggcttctctgctataataaattcatgaaaaaggagcgatttttgtgatcatacgtccaagtaaaccagcagatgctgctcaggtggccccgctgatcgatattgtctttactgaaatggaaataccgcagttaatgcgggttccaaaaccaaccttatatgcagttttgcaacaagcatttctactgcccacttatcgttacggttatccacaaattctggtagccgatcaggatgggcatattgaagggattgcggttgggtatttgcacgaacaagaagcacatatcgatgatgctttacgtcctttgttgccaaaacttgggttaaccccgcaatcatctttgtttacggataccgaaacttatccaggcgaatggtatcttgacaccttagccgtggcggccactgcgcaaggacatggcattggaaccaagttattacaagcggttgatccggttgcccgcgcccgcaaagccgatgtggtcagtttgaacgtggataagcagaatccgcgggctaagaagttatatgaacgcaatggctttgtcaaaaatggcgagctgatgattggcagccatcgctacgatcatatgattcggccagttggtgattaagtgaaaagtcggcacttacagctggtagtggaaccaaacaaaacggcactcgcgatgggaaatcttttgcgagtgccgttttgtttttcttaccatacttaaggtatcgtccattttttgtatcattacagcagttaaagcctcagtcggggaagtccagaccatattcataacgtttcaacggatccgccaccccgacatggcggaagcggtcgaggatagccgccagcaaaatggcagcaggaatgtcccgattgctgggaatcgtaagcttaacaattgccggagcgacttcttcggcactaaaaatggttttgacgccatggaagacctgataatgattgttgagcaagttacccatggcgacccaattaagtttggagataaaaatgaattggtgccagacgccaaacatttttttgacactggcaacattacgatcggcaatatataagtcatagcgaggaaaaacgctgactgttttttgacgaatcgaaccgagcggattgccgcttagtgtgttcaaatcaaatccgccattgataataccgtggcgggccgtcaaaatatacgccggtttgccattgtcggttttcaccacactcagactgccggtacttaacgcattcatatcaagatataacgccatttgcagacctcccaggaaaggtcacatgctgtgtttaaccgcaaagattagaaatgggcatttgatgcttctgccttgttaacgcgaatagccttgcgaattgcggcggcaacgccattttcgctgttggttttggtggtatcccatgccaaagcagtgatttcaggaatcgcatttcccatcgcaacgccatacttggccattttaatcatgctagcatcgttgagattatcgccaatcgtcatgacttcatccatcgtgataccccgttgcttggcataagcttcaacggcataacccttttgtgctttaatattgttaacttcaatgttgttggccgaacttgaggtgacactgagtttgccggtggcttcaaaagtctttgcgggtgcttttaaaatatcatgccgttcaccggtaaacgcgatgaacttcataatctggatcgttggatcgtccaataattcttggtagttatcaacgtaattgatattcatcagttcaagtcgagcagccgccagtgccaccgcaagtttgtaagttgtatcaggattcagatcaacgagcagatcggcaacattttgaatccgctctacgcgactatctgagaagacgcctttgttggtgacaacttcaaagtaaatgttgtctttttgcagctttttgacaatataatcgtttagatcgtcagcaattggaattgtgaccacgagcttgccagcctcgtcaaaaaccattgcgccatttaacgtgatgaaggcgggttttaagttctgagctgccaataagggttttgcctcagtcacgccgcgtccggttgcaaccatgaattcgataccagcggcttgcgcttcacggatggcctgggcgttttcgtctgagacttccattttgtcattcaaaagggtgccatccatgtccgatgcaataagtttaatcatatttacagttccctccggtttgtcatggtgccgttacgattttaattttagcatgaaaaacgcttgcccggtagcaaacgtgctgggattcttgtacactatttgcggaggtgcagcttttgaaaacattaatccataatgattggcagacggttctggaaccgatttttgaaagttccgaatatgcacggctgcatggctttttaaaagaagagtatgccactaaaacgatctatcccgagatgcatcatatcttccaggccttcgaatggaccccgtttcatgatgttaaagtggtgattttaggccaggatccttaccacaatccgcatcaggcagtgggggctagttttgcggttgcgcctggcgttgccttgccaccatcactgcagaatatttataaagaattgcaaagcgacttagggtatccacctgtgcaccacggctatcttaaagcgtgggcgaatcaaggcgttttattgctcaatgcggtcctgaccgtgcaggctggacacgcgtattcgcatcagaatcacggctgggaagcattaaccgatgccgcgattgccgctttgtcagcgcgcggtggcgtcgtgttcattttatggggcaatgcggccaagaaaaaagccgccttgattgacacttctaaaaatgccatcattgcgtccgcacatccaagtcctttatcagcatcacgtggtttttttggtagtcggccgttttctcgcacgaatgaggcattagagaaaatgggagagacgccgattaattggcagctgccagagacggttacgacagaaaattaaaatgatagcaacagccgtttaagtggtgcaaaccagtgattcccatttgtctcagcgtggacagtggggtgttgaggaacaagcagccgatttttccttctgacttctgctggtcataacccaataaaaacggtatgatgatacagaataaagcgcttttatggagggataaagtttggacctatttgaaagcttaaaagataaaattaacggtaaacatttgcggattgtatttccggaaggcgaggatccgcgagttttaggcgctgcagttcggcttgcagctgatggcctggttcaggcaattgtcttaggtaacccggataagattcaaagcctggccgccgaaaaaagctgggatctgagtaaattaaccgtacgcgatcctgaacatgacgagctccatgaccaaatggtgacggcgtttgtcgagcggcgtaaaggtaaggcgacccaagaacaagccgaaaagattgttcagaatgccaattattttgggaccatgctcgtttacatgaagaaagctgacgggatggtctccggtgcggtccattcaacggctgacacggtgcgcccggcgttacagatcattaaaacgcggcctggggttcatttagtgagtggtgctttcatcatgcaacgcggtcgggatgaacgatacttatttgccgataacgcgattaacatcgatccggatgctgaccaattggctgagattgcgattgaatcggctaaaactgccgcattgtttgatatcgaaccaccacgcgtggctttgttatcattctcgaccaaaggcagtgctaagggaccgcaagtggataaagtggttgaagcaaccaaaaaggcgcatgaattggcaccggatttggctttggatggcgaattacagtttgatgctgcctttgttccaaccgttgccaagcaaaaggctcctgattccaaggtagccggggaagctaacgtctttattttcccggaactgcaatcaggtaacattggctacaaaattgcccagcgattcggcggttttgaagcgattgggccaattcttcagggactgaatcaaccggtttccgatttaagccgtggtgcaaatgaagaagacgtctataaactggccattatcacggcggcccagaccttgctatgacaagcttaaagaaagatttcaccagtgaagctgcactgcaggcctttgctgcttcactgggaccgcatctgcaagcaggcgatgtgttactgttggacggtgatcttggcgctggcaagactagttttaccaaaggcttggctaaggggttgggcattacggattatgtcaaaagcccgactttcacgatcattcgtgaatatcgccatggtcgcctgccgctttatcatatggatctttatcgtttggaagatggtggcgccgaggatttagggttggaagaatatttcgaaggtgacggcgtttcggttgtcgagtggcctgactttctggggcttagtgaaccggaaaccgatctgctgattcattttcaaaaggatgataattcggataccacacgtcacttagaactggttccccgtggtccgcgttatgaggcgttacttcaaagcctcagctaatgtgttaatgatggtttgctagagaacattcggaaaaacaggatcgagcatgatcgcaagtcgaaaaagcgatgcccggtgctgtttttttgtttgaatcagccgagtaattgtctagctgaacgctcatattttgataactaaagtttgcatgctaaactaatagcaatgtgagctgttgaacgaataggaaggtaggtgcaaaatgttagaaatcaaggatctggtcaagactttcggtaccatgaccgccgttgatcatgtgagcttcacggtaaaacccggtgagatcatgggattgatcggacaaaatggcgcaggtaaaactacgacttttcgaatgattctgaatttcctgacgcctgattctggcaccattagttggaacgggcaaccactgacggccaaagattacgatatcattggctatttgccggaagaacgcgggttatatcctaaaatgcgggtgcaggatcaaattgtttattttgcccggttgcggggtatgaaaacagctgaaatcaaagcgaggattccggaatggctggaacggtttcaggttaaaggtaaggctacggataagatcaaggatttaagcaaaggcaatcagcaaaaagttcaagtgatcgcgacaatgatacatatgccaaagctggtcattcttgacgaaccgttttccggactcgacccggttaatgccagtttgttaatggccggcatcgagatgcttaaagacaacggcgcagcgattatctattccagccacgatatggccaatgttgaagccatttcggatcatttggtgatgcttaaacaagggcgtatggtcttgaatggtgccgtaaatgccattcgggaaagctttggccgcacaaaactgtttattgaatctggcttgtcggaagcggaattacaagcatttgacggggtgacacgtcttcgtcagcacggacaggagtttgagttgacactggcggatcccgcagtaggacggcaaatttttgccaaagcggtagcaaatggctacataccggaatttcgccaacaaccgcctacccttgatgaaattttccgcctgaaagtaggtgaatcaaatgcataagttttgggtcgtcatgagtcaggtttacaaaaagaacgtcaaaagtggttcgtggattttcctagtgttgtcgccattgctttttctggcaattggggtcggcattgcgttttatgtagccaaaacacaagcacctgcccaagtggccgttgtcagtgacgttagcgccgtgggtcaggcattaagcaaacaaagtaccgatgacttaaagtttaaggtttattcgtcagataaaaaagccaatgctgctttaaatgatgagaagattgacggcgttttaacggtgaaggccgctgaccatttccgttcccattatgtagcgcgcgataacgggcaaacggttgacacgtcgacccttgtcaccgcactgagcggccttaagctcagcagtaccgctgccagcatgcacttgacgcctgcacaagttaccgccttaacgcaaccgcctgtggttacctcaaaaacagtcgcgattgaagatggcaagcaagtacccaaatcagactccacgcaactcatgaaccatggtgttgccgttgtgtcgatggtgctgattctgatggtgacgatggtttacggctccattctcgcgcaggaaatcgcgacggaaaaaggctcccggattatggagatccttttatcatccgtcagtgccacgactcagttcttcggtaaactggccgggatcttcgccttgttgttgacgcagctggcaatttatcttgttgccggattgattggttggcaattccttaaaaaccaaagcatggtcgcaggggtcttgaaacagtttgatttctcgattctattttccgggactactggcatgatcgcgatcttctttgttattggaacactaacattttcggtgttagctgccttgacgggttcgctggtttccaatcaggagcaggtgcaacaagctgctatgccgattagcatgctgggtttagttggctacttcattaccattgccgcgcagtcaggtgattcaatgcttgctcaaatagccagttatgtgccgtttttaaatgtcttcgtgatgccgacgcaaatgtcactgggacgagcaagtatgggcgaagcgtggatcagtattgcaattagcatcgccttcttggccttatttacaatgttcacggtcaaagtctatcgcaacaatgtgttggtttactcaggctccggcttgtggcagtcgatgaagacatcctttagcatctggaagtcagagcggcatgtcgtaaaaagataagctgaaaaagaaattgtgaacgcttgactgaacgggtaaataaaaatggctggcaaagatgcatttcaacatttgacgagcagcgtgctgtttacaatttgaaaataaaaacgagtgcaatttttcgtgttaagctgcagcgaaaattgcactcgttttttagttttatgcgctaatttgttaatcgtcagcctgctttagctaatttcatcatggctttagtccgcgcctcaccaaaatgttcattttcggcaatgaggattcttgcgcaggcataactgtccgctaaggcgttgtgatggtgctcaagcggaatcttgagtgcagcactgactgtatccaaacgatgattcggtaactttggtaaaaactgccgtgatgttttaaccgtatcaatgacctgatagcgtggcgcggcaatgccatagcgatcaagtgtcaagcgcaatacggaaacgtcaaacggtgcgttgtgggcggtgacaatccgaccaggcgtataaaacatttgaatatgcggccaaacccgatcaaaagtcggctggtcttgaaccatatcaggtgtaatcccgtgaatccgaatgttttgcgggtcaaattgcatctgcgggttgatcagtgtgtaaaaactgtcaacaactcgattttgttgcacgacgactaaggcaagcgagcaagccgaagcccgtttgcgatttgccgtttcaaaatccatcgcaataaaatccatgtcatcttctcctaaactaagtcctgagtcaccaattcgacgggacagtgatcgctgcccataatttgcgttaaaatcttagcatcctgaatgtaaggttgaaaggctgagctggcgacaaaataatcaatccgccagccggcattgttagctcgcgcgtggaagcgataactccaccaggaatatgtgaccgtatccgggtaaaaatggcggaacgtgtcaatgaagccactattgagctgtttggtaaaatcagcacgctcttcatcggtaaagccggcgttgtggtgattggttttgtcatttttcaggtcgatgggttcatgggcaacatttaaatcgccacagtaaacgagtggtttctttgctgccagttcattcgtgtacgcgagaaaatcccgatcccactgctggcgataatcgagtcgtttgagctcgccaccggaattaggcgtatagaccgtcattaaataaaacttggtatattcaagcgtaatgatccgcccttcggtatcatgttcagggatgcccatgccatacgtgacattcagcggcttgtgcttagtaaaaatggcggttcccgaataacctttacgttcggcataattaaaatattgatagtagccgggcaaatcgagttctacctgaccagcctgcatcttcgtttcctgaagacaaaaccaatctgcatccaattcgttaaaaatcgtcataaagtctttttttaaaactgctcgtaagccgtttacattccatgaaatcattttcaacatgcttcactcctatcgctgctatgcgccttcattttactagactttacgggtgaatgcgactggtgctcataggtcatggcgtaaagtttaagtgggtgatatctgagcaaacaaaaagggagcgaatcccttcgtgctagaatgttaattgcaagaaaaacacgatagcagtaggaggaattcgctcttgtcacctatagtacaacaaatcattttagaaatgttgaaagaaattgatgaatctgtcatggagatggtcgcgggcaagctggatttaagtcaattcattttaaccaatcaggaaaactttcgtgagcacctctgccagttagttgggcaggcactggaacaagtggaccaagctattatggacagtgcttaccgccgtcgattctatagcgtcaaagataagcgggaacgcacttacttggcatccattggctcactggttttcacccgacgttattatcaagataaacggactggcgagcgtgtcttcttgcttgatgaactcgttggtattgagaagcgtagccgactttcgctcgacctcaaagctaagctgctggaagatgccgcccaaatgtcttacaagcaatcaggagatcgtaacggcgggggtacaaaaccatcgaagagcaccgtcatgcatgttgttcatagagacgggaaggccatcagcgctttggatcagttaaaggatcaaccaatgcccgtaccggaaacattatttgtcgaagccgatgaagatcatgtcccccatcaggacggcaccaatcatttcttgaaaatggtttatgtacatgaaggttatcggtctgtgggtaagaagtttcagttgattaggccattttatattaccggtgaatacccgggaacagctggtactgaagaaatctggcaaaccacgcttgattgcatcatgaaacaatatggcggtcagatgcccaaacgcttttttctggccggtgatggtgccagttggatcaaaaccggggccgattttctacccaactgcacggtggtctacgataaatttcacctacgtaaagcgtgcaaacaagcggcaattggcgtacccggtaatctgggcgatattctcatgcattgggcgttacaagggcactcaagctatctaaatgattatttccgtgttcggctcaatgaccctcagttacggtcgtcagaacgcaaagctgtccgacaagcacgaacgctcattcacaagaattggaaacaaattcaggccaacaatgatccagactttcacgggacatcagctgaaggtcatattagtcatatgctttcagagcgcttcagttcgcggccaatgggctggtcacaaactggcacagacaatttatcacagacgcgggtatacgtgcttaagggcggaaacgtttttgagcggttagaagccgaagccaaggaacgtcaccaaacaaagattgatattcgcgttgatgatcgtattaagattcagtttaaatcagcagccacgaaatactcacaagcggcgcaagcagcgtttgtagaactcgctagtgggaaacatcgcggctggcaatacggtatcacacatcagttgtaagttgaaaaagcattctagcaaaaagtttacaagttaaacccacaaaaagttgacgccgtcctcataggtcgttctgtgttcatgcgcccgaatttctgctaaaatagtaagtagtctttttgaaaggacctgatgttgtggtagacgcaccacggatacttgaaggtatcaccatgttgcatgatgagccgttgagtcattatacctttacaaaaaccggtgggccggctgatttgcttgcgtttcctaaagacgtggctgaagttcaggctttggttgaaatggctcgggagcgggatatgccgttaacggtcatcggcaacgccagcaatttaattgtgcgtgatggcggcattcgggggttagtcttgattttaacggcgatgaaaaaaatcaccgtgaatggtaacgatgtaacggctcaggcgggggcccggctgattgacacaaccgaagccgcttaccgggccggattaaccggacttgagtttgcggccgggattcccggcagtgtcggtggcgcgttattcatgaacgcgggcgcttataacggtgaagtctgcagtgtgatcagtcaggcttacgttttgacgcgcgcaggggaactcaaaacttacaatcatcgtgaattaaactttcgctatcggcatagtgtggttcaagataccggtgacattgtcttgagtgtcaccttttccatgaagtttggcgataagcctactattcgggccaagatggatgaactcaatgcaagacgggcagctaaacagccactggagtatccatcatgtggctcggtgtttaaacgtcccccggatcattttgttggtccgatgattcaaaaagccggtttgcaagggcatatcattggcggtgcgcaggtatcgaaaaaacatgccgggtttatcattaatttaggcaatgcaacggcaaccgattatcttgatatgatccaccttattcaaaaaacggttaaagccaagtttgacgttgacctagagcctgaagttcggatcattggcgaaccgttacactaagcaatatcttaaaatctatttgaaaggggctacacaatgcatttagtcgaagccgtcttattcttgatggcattggtcatcatctcaaacgtgctcagtcattacattgtggctgtcccggtttctttgattcaagtcgcgctgggactaggcgcggctttattttttcatttaacgatcaatttagcgactgattggtttatgttgcttttcattgccccgctgctgttttacgatggtcggcattttccgcggcgagaactatgggagttgcgtggtccgattatggggaacgccatttttctggtgtttgcaacgatgctggtcggaggttacttaattcatttcctgattccgccattaccgttaccagcgagttttgcgttggcagccatccttagtcctaccgatccgattgcggtacagagtttggctaagcgtgtgcatttgccaagcggggttttgcacttggtgagtggcgaaagtctgatcaacgatgccagtggcttgattgggtttaagtatggcatcgcggccaccatgaccggagcatttgcacttggccatgctgttcgggactttttctatgtggcgttagtaggggcgttagctggcttggtgctaatcggcttgattaatttgagtcgcaactggcttttgcaacaagggatcaatgatgtcattttgcatacgattttgcaggtgttgacaccgtttttcatttatttgattgtggatgaatttatgcatgcttctggcgtcattgctgtcgtagtagccggtttactgagcaatacgcagcataatcggtatgtcgctgcgttgccggagttgcggattgtttctgaacggacgtgggatttaattgtttataccctgaatgggattatttttcttatcttagggattgagcttcctgttgccatgcgggacacaatagccgatcatgaagtcaacacatggcaagctcttgaatttgttgtgattgtttatctcggcattttggttttgcggacgttatggatttatggctacatgtggcttacggttcgttcaaaaggcaatcctccttcttggcgggcggcgttgttaagcggtatttcgggtgtccgcggtgctattacgctagtcggtgtgtttgctgttcccgcggcattggcaaatggccagccgtttcccgagcgcagtctgatgctgtttattgctgccggcgttgtcgtcttgagcttaatcgtggcgattgtagccttgccgctggtgacgcgctcagtcgcaccgttgcaaacccgtggctccacgattgccgcagatggtagcagcgatgtcgccgaggatgatgaaaatagtcacgatgttcgcattatctctcagcgtcaagctcagctgtttgtctatcaaatggcagttcgtcgcgttgaatccgagcggcgggagtcaaatcaaaaagcggcacttgatctgatcgccgaatatcaaaacctgattcggcgcctggagctagccgaggataccggcgccgccattccgccattggttcaagatgagcttgatttacgtaaggtgggggtccaaggcgagttatatgcgttagatgacttatggcgcgagaacaaaatcatgtccaaaagttatgccaaagctcacaaacaactgcagcatcgtctggatgatttgaattcaatggcgaaacgctccggccgaccaacattgcgcatgcttcttgaccggtccgcgttgaagctatcccacttttggtacacggttgcgagtgaacagaatcgctcgcatcgctttttcaatgagaaactgtttattgaaaaggaaacggcaaaaggcggcttgaagtatttgtcccaatttctacgccaaaaagaaaacaaggcccatcattacaaccgtcaagtgatttattcgttgattgttcagtaccgcaatcgaattgcatcggttaaagcattgaacacccacaaatcaacgcaatatgaacatgaactcggccgattacgcgcgattgcgtttgcagtcgagcgaacggctattcacgacctacttgaaaaagggtatatcaccatggccatggcccagcgcttaaatcaaaatgttaacttcgcggaaaatgctgcaactttaacttcgatggaagaagtttaggaactgggattaaaaaatagctcgacaaacaaacggcgaccagatgttctcaaatgagcatgtgcgggcgccgttttgttgtatcaaagggcatttaagctgccgtgaaatttttttttgaaaatcagctataaaagcttgcgttggtgcgtgacgttcgtataataggcagagttagtaaacttaaagtttagtttaacgaaacttataaaggcggtgtgccatggacattggcagtaaaattcgtgatttgcgcattcgcaaaaacctgacccaagaagagttaggggaacgaactgatttatcaaagggttatatttcgcaagttgaacatgatcaaagttcgccgtcactggaaaccttttttgatattttaagcgttttaggtgagtcgccagccgattttttccgtgaagaaccagttgattcactggtctatcatgcttcggatcaggtgacttatcttgatgaggacaaaggttatcaattgaagtggttagttccggagagtaatgaaaacgagatggagccggtgatgattgattttgcaccggatgggatttttaaaactttcgaaccatcaccggcggaaacgtttgtgtatgtggttagcggcaaagtgaagttgttgctgggtgaacagacttatgtcgctaaaaaaggggaaactatttatttccacgcaacgaaacaacatcaactggtgaacgccgcaacgggtcgcagcaaatgcctgctggttgcgacggcatcttatctataaggagttggggtcattgagcaatatcattgttgaactgaagcatgtcggaaaacgttatggcgacacgcaggtattaaaagatgtcaatatcgaaattgaacaaggcaagttctacacattacttggtccgtccgggtctggtaagacgacgattctgcgcgccattgccgggtttctggatgtttcggaaggcgaagtgctttttgatggcaaacggattaatgatgtaccggcaaatcagcgcaaggttaatacggtattccaagattatgcgttattcccgcatcttaatgtttttgacaatgttgcgtttggattacgtctgcatcggatgagcaaggaaacgattaagaccaaggtgacagacgcgcttaaaatggttcggttgcaaggctatgctgaccgggaaatctctgaattgtctggcggccagcagcagcgggtagccatcgcccgcgccattgtgctggagccacaagtgttattgttggatgaaccattatcggcactggacgcaaagttacgtaaagatatgcagtatgagctgcgcgagttacaagaacggctcgggattacctttttgtttgtgacccatgatcaagaagaagcattggcactgtcagatgaaatttttgtcatgaatgatggtcaggttcagcaaagtggcaccccggttgatatttacgatgaaccggtgaatcactttgttgcggatttcattggtgaaagtaatatcattcaggggcatatgattaaagatttcctggtcgaatttaacggtaagcaatttgaatgtgccgatgcagggatgcggccgaatgaaccggtcgaagtggttttacggccagaagatcttgatatcaccgcagccgatgccggcaaagtgaacgttgaagtcgatacccaattattccgcggcgattattatgaaattgttgcttacgatcagcttaagaatgagtggttgattcattcgaccaatccggcaaaagacggcgagacggtggggttgacgtttgatcctgaagacattcacgttatgcggctaaacgaatccgaagaagaattcgatgcgcggctggaaacttatgaaggcgattaagcacagtattgacagcgactttactgtgaccgtgtccgttaacgcacggtttcggctaagcaccgtttgatttctaatctgaggagggtcatcgtgaaaaaatccaccacgaatgtagcattttacacgccttacgtgatgtggctcgcgttgtttgtgatcgcgccaatggtgttgatcgtttatcaaagtttctttgatattagcggccattttaccttggcaaattatcagacttattttcagtccggcacttatattatgatgacgattaattcagtctggtatgcctttttaatcacacttgcaacattgctaatcagctatccgaccgcttactttctgcattatgccaagcacaagcagctatggttgctgctgattattctgccaacctggattaacttgttgcttaaagcatatgcgtttattggcatttttagtcaggatggcggcgtgaatagtttcttgggcatgttcggaattgccccgcagcaatttttgtttactgatttcagctttatctttgtcgccgcttatattgaaattccgtttatgattttaccgattttcaatgcgattgaagaattacctgaaaatttggtcaatgcctcacgtgatttgggtgccaaaggctggcagacatttaccaaagttgtctggccactgaccatttccggcgttaaatcgggcgttcaggcagtgttcatccctagcttgagcctgttcatgttaacgcgcttgatcggcgggaaccgggtgatcacactagggaccgcgattgaagagcattttctcaccaccatgaactgggggatgggttccacaatcggcgtggtcttgattgtggccatgtttgtgattatgttcctaaccggtgaacgaaagaagaagggggtccgccgtcatgaagcgtaagtttaagtggtccaacctttatctgattttcgtcttcatctgtttatatgttccgattttttatctggtcatttattcattttcaaccggcgatcgtatgagtaactattccgggtttacctggaaacactatgccgaactttttgcggatacccggatgattcaaatcgttttggatacactgcttgtggcgttactatccagcctgatcgccacgattatcggggcattaggtgcgcttgcgattgatcgtaccagtcggccggtggttaaaaatacggtgctgtcattgaacaatattttaatggtcagtccggatgtcatcattggggccagtttcttaatcttttataccgcgttaaaagtgccgctgggtttctggtcggtactgatgagccatattgccttttccattccgattgtggtgttgatgattttaccgcggctacaggaaatgagccattccatgcttgatgctgcgcgtgatttgggtgcttcaaactatcaggtgctgacgcgggtcattgtgccatatatcacaccgggaattttctcgggtttcttcatggccttcacctattcgctggatgattttgccgtaaccttctttgtgaccggtaacggctttgaaacgctagcggtggaaatctatgcccgggcacgtcagggaattagcttggaaatcaacgcattatctggcgtgatgttcgtctttgctttgctgctggtggtggggtactactttatccaacaagcgggacagagcaggcgggcaaaacacaagcgagaaagcgaggcgttactcaatgaaacgactcattagtattgcggttgcgatcctggcagtctgtctcggattagctgtttggagcgagaacttacaaaaatcgcaaggagataccggtgacaatacactgaatctttttaattggggcgattatattgatccggccttgatcagtaaatttgaaaagcaaactggctatcatgtcaatcaagagacctttgattccaacgaagcgatgtttaccaagattcaacagggcggcaccagctatgacctgactgttccttcagattatatgatcgagaaaatgaagaaggccaatttgctattaccgctggataaaagtaaattacgcggcatgcagcatatggacccgcgtttaattaataaagaattcgatccaaacaacaagtacagcattccgtatttctggggcacactgggcattatttataatgacaagtttgtcaatgccagtgaggtccaacactggaaccaattgtggaatccgaagtttaaagattcgattatgttgatcgactcagcccgtgacgtttttgcgccagccttaatctcgctaggcaaatcggtcaacgaaactaatccgcagacgcttgctgttgccaaagccaaactcgatcagttatcacccaacgtcaaagctgtcgttgcggatgaaatcaagatgtacatggcagaaaatgaagctaaaattgccgtcgactggtcaggtgaagccagcgaaatgttggctaataataaacacctgcactatgtcgttcctcaagaaggcagcaatctctggtttgataaccttgtcattcctaagacggccaagcatttcaaagcgatctatgcctttctcaacttcatgatggagccaaagaacgccgctcaaaatgcagaatacgtgggttacgccacaccaaatgcaacggctaaaaagctattgcctaaaagtgttcaaaacgatcgccaattctaccctgatgacgaaactatgaaacatcttgagatctattccgatctgccacctgccaaagttggtctatacaatgatttattcttagaatttaagatgtaccgccgctgagggttttggtaccattcagtccgccacggttagcttaaaaggctgacttggcgggcttttttgtttggagcttttggctgctttaaaaaccttcgaaacgatgctttatatttttggacaacaaaaatagccctcaaaatcttaacgcttatggtggagaataagcattgacaggaagattttccgagggccgattattgcgtctaaatgttacttcacgttataggttttggtgccaatagtttggaaactggcattttcaaacgtaacagtcactggattatcattttttagttcataaataaagacaccttgaacagttttacctggtagtaagttattatgcatagcgttctcttgcgcttcgaaaggatttgagccatcgtcattcattttaggcattccgctggttaagtcgacatttgaagtgtcgtttttttgtttaacattcatcgataccattccagccattggcatctgttctttcttggaagtgtttgtaacgtccacaaataagacaagattcttctttccttgctcgtaggcatcctggacttctgctttagtgaacttgaaggtcatatttgctgtgacccaagtatcattcttaaaagaccaaccactttttggggtagaggttttgttttctgccttttctgctttttcagcagtggaagttttcgaggctgacgagttatccttacttgctgaactggaactactgcaaccggctaaaaaaaatattgataaggttgcgactgtcactaaaatcagttttttcattttctcctcctaggactatcatgctgactaagcaaccttgttttgcttgcgtggatgttgcaaaaacaggaacacaatagcaataattaatagaacaatagcaggaaacgcaaatacagcagaaatgccaaagcagagtgatccaatgactcccaggattccgccgacaagtgaaatatggtgtttgtagctctgccatagtgcaacagcgtttagaactacgccaatccacgcaactgtgtaaaagaaaatgcctgcgccagatgtgacattggttttattggccgcgtcattaacggcagttgcaaagataacaaaccaagatgatgcgaagataaagcaggcaacaatgtcgtaaatggcagtccaaatattaatctttatcttgcccataaaaatccaacccctttacaaaaagcttttgtatcataacgacacttaaataggatcaacaccaaagccttgtgtgataatacttagatacaacaattaggtttattttgatttgggatatcacttctttcataaatgccaacgtttcatgtaaatagtgcaatgggatttttattagttcgtaatttcccaataccgttttaaatttaaggcagtgagatagattaatgcaaactttacgcttgggcgtgcttattcggtttttttaaaagagtagtacaagcagctgcaatcgggtaccatagtgatgaggtgatcgcgatgaagaagcatagtcggcatagtgaaggcgtgtggctggatatcgtttgttgtatcagtctatggctggcggttggaagtttggtggccgcagcgacggtgattcatattaatcggccatatatcattattgtgttggcattagctttttgtgcgattggcgaaacggtggcggtttttaaaaattggtgattggccagaatgatctgcatcagctaggtaagttctggatatgcacccgctttcattttcgcgacgagtgtagcataagtttatttcgtttatcaaaagatatgcatggtaatttggctttaaaaattaaaagtgacactaaaaaatggcctcggaaagttcaaattccaaggccattttcttagtgttgcttattcgacacgctttaccttcgcatgggctaagcgccgacgattgagccatttccgtccttcttcgattaagaagagtggaatcgggatgatggctaggaagatccaatcggtgagggctagtgggcccgtgtggaagagttcctgtaagaacggggtgtaactgagtagggccagcaggaaaatttcaaagataatgccgaaccagacaagtcgattggcaaacaaaccgactttgaagactgaggcattttccgtgcggcaattcatggctgcagcaatttgacagaagataatcgcagctaaggtcatggtagtcgccatgacataagttgaaccgcttgtggctaaaccgtgtgtcggccagccgtccagatgattgacgaagaagtaagcgccgctagagatgattgaagcaatcagaccgtaccacgcgaaggctttccacaagacggttcggctcatcaggtgagcattacgtgcgcgcggtggtttgtccataatcccgggctcggctttttcagatcccagtcccaaagcaggcatcatgtcggttccgaggtcaacggttaagatttgcatcacggttaacggtaggggaatagcgccacgtgagaagaggaaaagcgcagatggcacagcttcaggcaggttagagttcaaaatataaatcaggaacttttgaatgttgctgtaaacagttcggccttcttcaatcgccgcaacgatagaagcaaaattgtcgtccgtgagaatcatatcggctgcatctttggcgacgtctgttcctgtcacgcccattgccacgccaatatcggcttttttcaaagcgggtgcatcattgacgccatcaccggtggaagcaacaatttcacccatttcttgaagggttgagacaattttatatttttgttccggtgctacccgcgcaaaaatgatttcaccagcaagcgcttgtttgaggtcggctttactcatagcatccagttcggtgccggtgacgacgcgggctttatcagaggttaagccgattttgaccgcgatggatttagcagtcaacgatgaatcgccggtgaccataataatcttgatactggcgttatgacactttttgatagccgcgtaaatctctggccgtggcggatcggacataatcgcaaggccaacgaatgtgagcttggtttcagccgtttcaatcgtcagaccatcgagctgtttttctttgtcagctgcttgcgggatttcgcgatatgccgtggcaattgaccgcaaacctaaagctgcatatttacggttggccgcatcgatggcatctttgtcagcttgcgttagcggtcggactttaccattttcttgaatggtatcgcaatgtggtaataaatcgcttaatgagcctttggtacagatggagagcgtctggggatcgtgttggtggatggtggtcatgcgctttcgatccgagtcgaacggcaattctttgagtcgcgggaacttctgggtgtaggcgttcgtatcgatgcctgatttttgcgccaaaatgaccagcgaggcttcggttggagtgccgagaattttcggtcgtgctttgccttttgccggttcgacttcagtatcattattaaacgcgaccagtcggatgagtaaatccaggtccggatcgctgccatagtgaatcggttgaccgtttagctggatctcgccgttgttgacatagccttggccagtgacggtataagtgtgcgccggcgtccagacgtgatcaactgtcatctgattctgtgttagggtgccggttttatccgagcagataacggtggtttcaccaagcgtttcgacactgtttagatctttgagtaaggcgtgtttttttgccatccgctgaacgccttgtgccagcgacaacgtgacagtcggtaaaagcccttccggaataaacgcaacgatcatgcctagcgcaaaaataaagctttgcgcgaccggataatggacaaagaaaatagcagcaacgaagaaaagtacccctaaactgatcgcaatcaacgaaatctgtttggttaagcgattgagttccagttgcaatgggcttagactgcgcttttgttgctgggttaacgcggcaatctggccgaattccgtatgcatccccgttgcaaacgccaccgccgttgcagtaccggcgccaacagtggtaccggcataaacaaggttggactcggcaaactcgccttgtccggcatcaaaagcaacttttttggattcgggtacggattcaccggttaaggcactttgatcaacctgaacggaggtagctttgattaaccgggcgtcaacagggaccgcattaccggcttgcagattaaacacatcgccagggacaatttgggtcgcattaacttgctgcaacttgccatcacgatagacctgcgtataggtcggcagcattttcataagtgaattcgtcgctttttgagcttcatgttcttgccagtagctgaaaataccattaataatattgactaaccaaattgcgatgcctagctccaatgtgccggacaaaatggcaacaaatccgctgacccaaagtaagatcgccatcacgctggtaaagttcttgagaaagatcaacaactgtgatgcctgcttttcgcgggtaatcgtattttcaccgtattttgcgagccgggttgaagcttcctgttgactcaatccggttgaagttgtgtgtaaatcagtcattaaatctgcaattgattcagtggcaaacttacgccgcgtctccttttcattcttcatgactcaagcacgtctcctttgaaaaaacgtttaactccattctaacgttctgcgggatggaaaacaccaaaagtgctaattttcatgagttggcggggcaggataagcgacttctccttgtaagccgcgctcaagaaaggtgacggcttcattaaccgcggtgttgagatcaaattgtgattggatatcgagtatgaccggaagcagataactgaacaccgtgccgaaaacgtactgcagaattcggatcaccggccaattaacgagaacgcctttttcctggtatgcggttagtaaatgcgtggcttcacccagaaattgcgtttgaaactgttctgctagtgtcttgctcaaagatgaatcgcgcaaaagggtggcaataagaatgcgcaattgagcttgattggtgatggcaaatgtcatgcgatcgcggacaataaacgttaaaaaagtatgcaaatcaggcagatgatgctcgccaacttcatgaataaactctgtgatcgcgctggggatgacctgttgaatcatcggagccaatagcgcacggagaataccttctttggttttaaattgtttgtagacagtgccttcgctgacttgggcgacccgggcaatttcttgggtactggtgcgatcgtatccttgttcggagaagagctttaaactggccttgagtacggcttgttgtttggttgatagctgactatctgcaagtgatgccgagaataaatcggtgatattatgcggtttcatcgagctacacttctttcataaattgaattaatttcagacttgacgatatttgcgcattgtcaaaagattcaggcctaaaaatagcaggaaaaagcctactaatgcaatgacatcagggtataaaactgctagtgattggcctttggtaataattccggttaacgcattggcaccataataaagtggcattaaatgcgcaatgggttgcagccatccaagcatctgattgacaggaatcaatccggtgaaaaaaatctgggggatcacaataataggaataaactgcaacatctgaaactcactgttggcaaaggttgaaatgagcaagccaagcgcaagtgctgttaatgccagcagtaaattgattagaaaaatggccggaatgctgccaagaatttggatcttaaagaccaccaaggcatagccgacaatcaaaaccgtttgaatgaccgcaaagatcccgtaaccaagtaggtacccactgatgatttcaccgcgacgaatcggagtcgccagcaagcgataaagcgttccagttgtccgttcgcgcagtaaggcaatgccggaaatcaaaaagacaaagaagaagacgataaagccaataagaatcggtaacaaagtatcaaagtaagtggattcagccgacccgtagcgatagtgggttgtcatgcgataattggtctgcttgggttgttgcgggatggggacttgtaccgcaccgtgcgtggcttgttgtaacgcgcccgccagtttatttaaggcaatcgcttgtgttttaaggctggtggccgcagcttttagtcttaacttaacggtggcagcctgtaatgtttgcttcaacagcgtgctttgtccctgatcggtgttggcaagcgttaacgtaagctgatcgccatgttgcgttaaaacgcctgcataatcatgctgtttgattatgcgggtaggtttttcagtgccaacgtgatgtaatcttacatgcttcgtatccatcgtcttggttaaggatgtttggacgccatgcacggccaaatcaacctttgtcgttgtgttggattgaaataagaagaagattaacgtcatgataaacaaaggcgcgataaacattaaggccagagtgcgtttgtcgcgtaacatttccttgaaaattcgtatcatcaaagcttcagtgcgcatcttgctgcctccctgcggctagaaataccgtttcaatcgaatctgcttgatagtcaacttgcaactgcttcggtgtgccttgagcgattgcttgaccattgcgaatcatcatgagcagatccgcttcttcagcgtccgccatcacatgggtggttaaaataattgtcacgccttgttttgccagtcgatgcaattcctgccaaatctggcgacgtaacgcaggatcgatgccaatcgttggctcgtctaaaatcaacaattgtggtttggcaattaaagcgatggccaacgataaacgtcttttcattccacctgaataatccttgacgggttgtttaagggcagtttgtaaatcaacaacgtcagcagcatacattaactgtttggtcagtaaggaacggccaacgccttgcattttggcaaaaaaagtgagattttcggctccggttaagctttcgtacaacgcatcggtttgcgccataaaaccaatgcggcctaataataatcgattgggaacgtgctggttaaaaacggtaaccttcccggcgcgaggacggatcatccccataatggtgctgatcaaagttgttttaccagcgccactaggaccgatcaaagcgagaatctgaccgcgattcaacgttagattgatgtggctaagcaccgtttttgtaccgtagccttgttgaagatcggaaacctggacgattgtttgagttgacatttgatttgcaccttctttttttgatagtgagtactcactcacctgcattgtaagctatttgttaaaaaatgcaactgatttacgtatctcgaccgatgcctaggaattgcggcgatgaggctaattgtgatgctgcgtttgaacttggaggctgtgaaggcggtgccacgcttcgtcatttgtttccgtcctcgcccgttcggtttctcgtggtataattattcagaagttcgatttttaacaataatggagggacgcggatgcgcacctatctcgcaaacttattaacttggtccacacttattaatttggttgacatcctcgtcgtctggtacgtcatttatcgcttgattatgctggttcgcggtacaaaggcggttcaattacttaaaggcgtttttgtgattgcggccatcaagatcatttcctggttcttgcagctgaaaacagttgggtatttaacggatttggtgattacatggagtgttccggcgctggtgatcatttttcagcctgaaattcgtcgcgggttggaacatcttggtcggggctcactgattttccgtagcaataataatcagcatgaagcagaagcacggatggtcaaggaattggataaagcaattcagtacatgagcaagcgtcgaatcggggcattgatcaccattcaaaagaataccggccttgaagattatatcgagacggggattccgcttgatgccgatattagcggtgaattactgatcaatatttttattcctaatacaccgctgcatgatggggcagtcattattcgggataatcggattgctgtcgctgcggcctatttgccattgtctgatagcaacctcattcccaaagaacttggcacccgtcatcgggcggcagtggggatcagtgaggtcacggatgctttgacaattgttgtgtcagaagaaaccggggaagtcacgattacgaataacaacaacttgattcgcaatctgacccgtgaagactacatgaagtttctgaccgcacagctggtacctaaagaagaagcacctgatcccaatccggttgtcagtttcttttcacgtctttttagtcaacgtaaaaagaaggagggcaagcaatgaatcgcttatgggataaaccatgggtcaatcggttgttagccttgcttcttgcaatcggtttgtttgcctatgttaatgtcgagagtattaataatacccggcaaagtgccaatgatgacaccaccttggtcgctaataaaacgcagaccgtgaaagtgccgcttcaggttaatgccaataccgacaagtattttattaccggatatccgtcaaaagtttcagtagcattgacgggcacggcttctttagtcacaatgacagcaaacacacagaattttcgcgtcattgctgatttaaccaatttgggtgtcgggaaacaccgggttcggctgaaggcggaaggattgaataaggatcttagctattctatttcgccaaagtcagtgaaagttgacatccaggttcgggataacaagacgatgccgattcaggttcggtataataaggcaagtattgcatctggctatgcagctggtgaaccgaaactttcaacgcgcactgttgaagtgaccggtgcccgctccgttatcgattctattgcgcaagtggttgcaaatgtctcgttagcgcataatacgcgtaagtcggttgatcaagaagtcttattacaggcactggatgacaatggcaataccatgaatgttgttctatcaccgcaaacagtgcatgtcaccttgccaatttcccagcccagtaaaaaaataaatgtcgagctgaagcaaactggcaatgccgtctccggacatacgtatgccttgtcgtcagatacaaaacaggttaccgtatatggagatcaacagagtttggacaagctcagtaaattgaccgttcccgttgatgtcagtgacataacatcaagtactacccgaacatttaatgtcacggatttaaacgatggtatttctgccgctagtccggaaacgattaaagtgactgtcagtgttggtaataccggtagcggtgatgacgacaatagtggtaataatagcagtggcgctgagagctcggctacttcatcaaagactgctagtacaagtgccagtgcttctcaatcaagctcatcaccagtgcttctcaatcaagctcatcaagtgaaagcacatcgacaagtgaagattaatgactggaagaaatgaggaagaattaagatgacaaagtattttggtaccgatggtgttcgcggcattgctaacaaggaattgagtccggaaatggcgtttcggttaggccggacaggcggatacgttttaacgcagcataaggaagatgccagtcgccgcccattggttttggttgctcgcgatacgcgaatttctggccagatgttggccgatgcattgattgccggtttactgtcggtcggaattgaagtgctggatcttggtgttattaccacaccggctgtggcttatttgattaaaattcaaggggccgatgccggaattcagatttctgcttcacacaatccggtagcagacaacggcattaagttcttcggcgccgatggttataaactctccgatgaaaccgaagaagaaatcgaagccttgctggatgcaccggaagacaagttgccgcgccctgctgcagaaggattgggaacagtcgatgattatcctgaaggtgcccttaaatatacgcagttcttggaacagacgcttgctgatgatttgagtggcattcatgtttgtctagacggcgctaatggtgccaccagcggattggtcagccgtatttttgctgatcttgaaaccgactttgatacgatggcgacaacgccggatggtttgaacattaacgccgatgttggctcaacccatccgcaagccttagctaaattcgtggttgaaaaaggggccgatgttggcttggcctttgatggtgacggtgatcgctgcatcgcggtcgatgaggaaggcaatattgtcgacggcgataagatcatgttcatcctgggcaactacatgaagtctcaaggtcgattaaagcaggacacagtcgttacaaccgttatgagcaatctcggcttgtataaggcgttggaagcaaatggcatgaagtcggttcaaacggcagtcggtgatcggcatgttgttgaagcgatgcgcaaagacggctataacattggtggcgagcaatccggccacatcattttgtttgactaccacaacactggcgatgggatgctcacgggtattcacttgctgaatgttatgaaaaagactggcaaaaagctttctgaactggcaacaccggttaaggactacccgcaaaaacttgtcaacgtaaaagtggcggacaaagaaaattggcaagcctatccggaaatccaagcagccattgataccgtggaaaaagaaatggctggtgatggacgggtactcgtccgcccttcaggtactgaaccacttttgcgggtcatggcagaagccaaaaccgaggacttggtgtcacgatatgttgatcaaattgtcgatgttgttaagcaggaaatggggagctcggaagcttaattctgtttcgaatggaatcgccagctcgtttagtttgagttagataaccaaagctcaaacttgatggtaaggtggatcagcattcgataaatctttccaaaagtggatcgaggctgaggcataattcgcagcttcaaaataaaatcgaactatttctcgttccaatcgagaaatagttcgattttttagattccttgcataagcataaatagactttaacgattccagtgccaaagcggagcaatcgtaggccagatggggctcagccgtggaacaacacagcgaccgggctttgtcgctgatgttgttaggcgacttggagactgccggtcttgcaggctccaagcgccgtcacagcgttccagcactatctggccggagattgcggagtttggcacggcccggaactatctttcttacttatcctccacagtattcggattttaatcagcatcagattctaaaatagaattatgacccagcctctatcaatttttttcggtggccgttgctaggcgtattctttaaatttttttaagactaaagtgcgcgtttgggcaaaaccttgttataaagggaaacgattaaccgaaatgccggcttttggcgatcagatatagaccggttttacttacgaaagtataccactaaaaaataggtgttgacatatcgctttgtaaaacatatagttagccttgtttttaacaataccaataaataaacctgtctaaaccaattttgagacagtcggaaaaggatgttgactatgtgtggaatcgtcggtgttatcggtaagaaaaatgcaacccaaatcttgcttaagggacttgaaaaacttgagtatcgtggttacgactcagcaggtatttacgttaatgatcaggcaggccatgatcatttgattaagcgggttggccatatttcgaacttggaagaagcagtaacgcctgatgttcaaggtgtgatggggattgggcatacacgttgggcgaccaatggcggtccgaccgaagccaacgcacatccgcaagtttccaacgatgaacgcttttatctcgtgcataacggggttgtgaccaacgctaatgacttgaagcaacagtatcttcaagatattgaattgcacagtgatactgatacagaagtcgtggttcaactcattgcactattcgctcgggaaggattgtcagccaaagaagcctttcgaaaaacgttgaaaatgattcaaggttcctatgctttttcgatggttgatcgtttggatccgacagttttgtatatcgctaaaaataagagtcctttattgattggtcgcggtgaaggcttcaatgtcgttgcttcagatgcattggcgatgttgagtgaaactgatcagtttgttgaactgaaagaccaggaaattgtgacgctaaccgctgatgcagttcatatcgagacccttgatggcaaggtagaagatcgcaagccgtttaccgtcaaagttgatgatggtgaagtttcaaagggaacctatccattcttcatgctcaaggaaattgatgagcagccaattgtgatgcggcgactggttgaaaagtataccgatgatcagcagcatgtggtgattcctgaagacttaatgaaagccttacagaatgcagatcggctttacattgttgccgcggggaccagctaccatgccggcttggttggcgctcctttgtttgaacagctggctggcattccaaccgaagtccatgttgcttcggaatttgcttatcatcagccattactctccaaacatccgttgtttatttttctgacccaaagtggtgaaactgctgatattcgtcaggttttggttgaagtcaaagcgcaaggttatcagacactgacgattaccaatgttggcagctcaacccttgcccgtgaagcaactttcaccttgttactgcatggcgggccggaaattgcggtcgcgtcaaccaaggcttacaccgcgcaaattgcggtagaagccttggtagccaaagccgttggtgaagcaaaaggcttacaaaacgctaaggactttgatgtgattcaccaattaggtttggcagcaaccggccaacaagcactgattgatcaaaaggatcggattcatgaattggcaaccgatatgttcaaaaccacgcgcaatgctttttacattggccgtggcggcgactactatgccagtcttgaagccgcattgaaactcaaggaaatcagttatgtgcaggctgaagggtttgcggctggcgaattaaagcacggcaccatcgctttaattgaaaaggataccccagtcgttgccatcatctctgacccagtgaccgctgctcggacccgcagcaatgccgatgaagtgcaggcgcgcggagccaaagtgttacacattgccatggcgagccaagcccaaaaaggtgaccagattatcgtcgacgaaattgatccgcttctggcgccactggttacgatcatcccggcacaactgctggcttacttcacgagttccgatcgtgggtatgacgttgaccgtccccgcaacttggctaagtcggttactgttgaataggtctaagctcataatggcgtgaaaaattccatgacagttaagttgatatttaaatttaatgtcagtggggattaaacaaaaaaactgttcgccgaatgtggcaaacagtttttttgtttattgaaggctaccgagcgatctaaagaaggctacttaagatacgcttcacttaatgccatgaattgttgggcatctttagcggctaaatcaattccttgctgccaaaattctggttgggtcaagtcaacgccgagatgctttttcgctagtgcttccgtgctcatgttggcggtgtcccgcaataaggcaatataatcatcttcaaaatgatcgctttgctgtgccttagcgtaaataccgctagaaaacaggtagccaaatgtatatgggaagttataaaacggtgggttgtcaaaataaaagtgcaacttatcggcccaatacatcggatcaaatgaactcaagccgccagcgtaagccttctcctgagccgcggtcatcaaggctttcaggcggggaacgctgacaataccatgctcacgttcttgatagaaactgtcttcaaacaagaatcgcgcatgaatgttgagcagcatcgctaatggattggccatttttgcgtctaataagttgagcttttctgccggttcgctagcagctttcaccgtcgcatcggcaacaatcaattcggcaaaagttgaggcagtttcggcaacgttcatggcatagttttgccgcaaaaccggcatatccttcaaaatagaactgtggaaagcatgccctagttcatgagcaatggttgatacaccagacgccgaaccgtcaaaggtcatgaaaatgcgactttctttgacatccggaacgctggtcatgtaaccgcctgcccgtttgcccggtcgatcttctgcttcaatccagccattttcaaacgcatgttgcgcaaaggcggccattttaggtgaaaacttcgcaaaattattaacaatgaattctgcagcttcgtcaaaagtgtaggtcttcggcttgaagtcgccaacaaccactggtgcccattgatcttgccattgcatggtggactgcccggttaattgggctttgcgggtgagataggcagcgaagggcgctttattggcgctgatggtttgccacatttgatccaaggtggcacgcttcatccggttatattgcagtggcttgtatagataatccggatactgatgtaagcgatagttggtcaagcggaacccggcaatgtggttgagggtttcgccaaacaaactggcatgatcgctccaaacttgttcccaaacattgaaaacgtccttgcgcgtcttaggatcaggcgcaccttcaaacttgttttgcgtttggccggcacttagctcggtcgtttcgccattttgagtgatcgggaacttaagactgccactgagcgttgtatagtgattactccagccggcgaatccatcaaccgccaagtcattgatcatggtttcggttttatcatcaagtaattccttggcttgatcacgaatttcacttaaaccgaaacgactctcagccaatgtaccagtagccgtcaactgatcgaaagcagtttgtggcatgccggctaatttctttgccaaggggttgttaatgttttgaaaacgggtttctagtgttgtaagttgtcctagcaggggaccggtttttaagttggcagtatcggcgctggcaatcatttcgacaaaactgcctgtggtgccgagacctttactgatatcttcaaaaagttgccaaagcgttttgaaatcggtaaactcaggggcatcatcttcaggcgaccacgctgctacttgggcttcaagttggggcaattcgtcggtcactgtctgaatccgtgcggtaagttgtggcgagtcgatgccacctgggaagattgaatcaagattccaattaatggggtaagacataacagcacttcctttccaaataggttcattatacagtagatgagaaaagtatgagtgaaagtaggttgaatttgtgaattcttttaaacggcattggggattatggttgacggccgcaattttatttgttttgttcgtcagttctagcatgacttataaggaacaaacaaccgtcccgttaatggaacggttgttgcataatgagccgttcaagccattcttaagtagcattcagtttaattatgccggcgagacacagtcagttgctaaagtcggatattttaagttcgttgaattttttgtgcgcaaaggggcccacgttagtatctttttcttattgggcttgggtttgacgcaagggacgtttatgtatcaaaaaaatcggtggttgcattggccgctgatggtgttgagttgtaccggaattgcagcatttgatgagtttcatcaaatgctgacaggcgggcgcacgccgttgtttcaggatgtgatgctagacactgttgccgctgcgattgcggtgaccttcatgtggggatggttgtggcgtcagaagcggcgttgaataaccgcgcgttctttgctataattttaacgatccatatgcttctatacttatgaaaagagggtttatcatgtcaggacattccaaatggcataacattcagggccgtaagaacgctcaggatgcgaagcgtggtaagattttccagaagttatcacgtgaattatacatggcagcaaagcaaggtggtcctgaccccagtggtaacccatccctccgtttggtcatggacaaagccaaagctgccaacatgcctaaggacaatatcaagcgggcattagacaaggctagtgatcgcgatgcggctaattatgatgaagttacctatgaaggctatggcccgggtggcgttgcaatcctggttgaagcgttaacggacaatcggaatcgaacctccagttcagttcgagttgccatcacccgtcatggtggcaatatggcggcagccggtgcggtttcttacatgtttgatcgcaaagggtatctcgttatctcacgtgaagcgtatgatgtcgatgaagatcagatgttagaagatgcactcgaagcaggggctgaagatatgcaaacttcagacgatgcttacgaaatctacaccgatcccaaagaattcgcacaggttcgtgatgctttggaagaaaaagggtataaattcgtccaaaacgaattgacgatggtaccacaaaatctgaccccgattcctaaagataaagtcgaacaattccaagccatgatcgatcagctagaagacgatgatgatgtgcaagaagtctacacagctggcgactggccggacgattaatgagttgaataaatgagtgaagaggctgggctatcattcccagtttcaaactaaaggcgtactatttctcggatttgacgagaaatggtacgccttttagattctctacattagtatcaatagcatttaacgattttagcaccaaggcggagtaatctctggctagatggatggcgttgcatagctagggcggaaacagtgcggctaagggacagagtatgcgcatcttgagacataatgatcgtattttaatcaccgtgaccaacgtccttatgtgcagacgatgacatccgaaaaagcatgacgggtaaattttttatgttaatgacaaactcgtccttgcctgcgaattcttttaatgcaggaggaaaaaatatgcagtcagtgaaaacgttattgaccaacgcattagccaaaggagccagcgatatttactatttgccaaatccgcatggttatctgattcggcttcggttaccgacagggttagtgactttagggcaactggaaacgcgcataggtcagcaagagattaattatctgaagttcatggctgggatgaatgttgcggagcatcgccgcgtccagttaggcgccttttatcatccggactcaaatgtctttctgcgtttaagttcggttgcggattttcggggccgcgaatcattggtggtgcgactgatcagtggtattcccgatgcgcagggtgcacgtcagttgttggatcggttaatgagtattttgacgcaacgccgaggcatgttgacattggctggcccaaccggatcgggtaaaacaacgttactgtaccagcttgcaactcgcttggccgcctcgaaaatggtgctgtctattgaggatcctgtcgaaattaaccagccccagtttctgcaacttcaggttaacccagaagcggaaatgagttatccgcagttgttaaaggccgctttacgtcatcgcccggatgtattgctgattggtgaaatccgcgatcggcaaaccgcccagagcgcctgtgaagctgccattagcggtcatattgtgcttgcgaccgtgcatgcacgttcggccaacgacaccccactgagactgactagctttggcttacctgccgaattggtttctgccgccttaacagccagtgccgcaatcacgttgcagtatcgacctacgattcatcctgtcgctgaagtggttgtttttgagccggcgcatcaaagcggtgcaacggaggtggtttcgtgaaagtgcctctgatcgttcaggaacgtttttgtcgtcaaagtgcagccttaatgacggcgggtttcaatctgagtgacgtgttcgcctatttgcaagtgagtttgcctaaacacgccgcgatttggcaaggaattgaaaacgaattggctaacggcatggccttttcggatgcagttgcacgccaggatctggccccgattcttttccaacaattgcagttggctcaggttcatggtgacttagcgaaggcgttgacgattgcggcggattatcttcacttgcgggttcgcaatcggcaacgcattgtacagttgctggtttatccgtgtctgttattggcaatgctggtggtcttacagattgtcgttgtttttggcgttcttcctgcactttctttaccacagtcgaatttagtcgcgcttcaattgattgggttgggcgtggtgacagtgattggactcttgggttactgctactggcatcgtatgtcgccgctcaaacgtctactggtgttacagaaggttccggggatgcgccaactgctacgaacttattatcagtttcagtttacagcaggagcagctcaatttttattggcgggtgcagatattgccaacttttgccagcacttagcaaccttagacggaccgatggggaaattaggcacacgcattcaggcgaaggttcaacagggacacgaattaagtgtggcgcttcaagagccgttgattcccgctgaggttgcccgtttgctaaccatgggccaatcgcatcatttggtcgcaaccgggttaaaactttttggtgaacagcttttctcgcggcttcaacagcaattggaacgactggtgagcttggtacagccgtttttgtttctaatcatcggcggagagattttactggtgtatttacaaatcttattaccactttatcaatctatagggggttaagcatgaaacgaaaaaagttgcgcgcatttaccttaattgaagtagttgcggcgctgggggtcattattctactgacgctcgcgctggttttgaccattcagggccagatgaaacgtgtcgatactcagaacctgaaagcaaccgtggcgacggtcaacacgcaattggaaatgacttacaatgagccagatcacggcggggttgattttagttctccggatcaattagttaaaaaagacgtgatttcacaaagccaggcagacacccttagaaaaggcgggtttaagctgacagcaggatcaccaccgacatttagcaaatgaaacggctacatggttttaccttgattgaagtcgtggctgtcatgtttgtcataactgcattagcaatcgttgcggttccggttggccgaaatgttttaacgcaataccgcgaacgtgaatttatggaggccttggtggaagaatgggaaatgctaaaaatgcgggcgagagctgaaccatcagatggcaatatgtatgtgaatggtgaagagagggaagttagattcgtgactcaaggaacgacaaagacatttcctttcccggtatcactgacatttagtgggaggggttggatgagttgtaatcctcatgggaaaataaagcaagcgggaactttaaacttttcaaatgagaaaaagtttgcttgggtgattacgttccagctgggatgggggcgagcaatattgaccaaaaattaagtggggtgttgttagtcgaacatcttgcggctttgggcgtggttctcatggctgtgggttggttggcgttattgatgaggacttatcagcaagttgtcatacctgtccgacaagaaaccactgcttactatgccgctcgcgttgctttaatgcgggtgcctgcgcgtggtggggaaactcaggttagcgttggccctgatgtttggaaggtagtgatgagcgcaaaggaggttcgggttgatgccaataactcgacggccagctatacctttaacccttagcgccttcaccttgatcgaagttgtgattggattaggaatcatagtcgcggtgatgttgctttggtcgccgcttttgacaggcgttcaacgttttacaaatcaagatcaatatttactgcatgcactgcaagcagatgcagacttacaggctaatgtgcggacccatcggatgaaactcgagtcgcttaaacagaaacgggtcaggcttcagggaaaagatggtcatcaatcgaaattttatgtttttgagttttataccaaaaatggcaacagtatgattcgcgctagaaccaatgatgggggccatattccattatttatgcaaatcaagtccggccaatttttggggtccgttcatggctttttgtatgagataagattgggtactaaccagacttttgaaggcggggtgcggcttaatcaatgaaattacgtggaagtgtgctggttaataccatcattttattcggtatatttttgacgatgacaattgggatgtttaagcagtttaaccgctggcagcagcattatcaaattattaagcaagtcgaaaagtcccagtttaagtcggcttattcgcagtggcggcaaaatgcggaaggagtcaaccatcatgataagtcagaaacagctgacagtgcgagcttgaaatctagtcaggcgagtgaagtaagtgtcagtccaacgaggtcaatgccagtggttgaaaagacggtcagtgagacagataccaaatcggtgccctaggttaaagaatgatcccgcttgaataaggtatttccaatcggtacactggtaaacggagcgttgaaggggcgcgttagcagcagactcccaataaaatgcttattggccatatttggtcatgatgatgcgcgcctcggttaggccggttcgcgctcaatcataacgcgctcaccagcccagaagtctgcgtgtaaggacctcagtcgcaatgaccaaagtgcggccatcacgcccaaggctgcttacactccgacttctaagcgcgccggttcgcgctcaatcataacgcgctcaccagcccagaagtctgcgtgtaaggaccttggtcgcaatggccaagcccgggccatcacgcccaaggccgcttacactccgacttctaaccgggctggttcgcgctcactttatttagggggttgtctttgtggcgaatgaacaccttgagaagctttatcatgttttggatgaaagcacgacgattttgcatcagcagttgaaatctactgatattgcggcaattaccgaagctggcgaagatctttcttctggtgaagtgatgcaagaagatgggttgcctaacgatgaagctaagaagaaactggaagctttgtttggtcaggtgaagttggcaacatatgaaccggaagagatacggcaggctttgcagctggtactggttaaagcgatcaaagttgatgggattgaacccaataaacagatcacaccggatgccatggccagtcttgcaacctttatggcgaccgtttttgatcagcagcagccgagccaactcaaagtggcggacttggcagttggaagcgggaacttgttgtttgcagtgatgaatcaactacacaaagaacgtgacgttacggtaaaaggttacggtgttgataatgacgaggccttgttggcggttgccgggatgagcagcagcttgcaacacctggacgttgaactgtttcatcaagatgcattggatgggcttttatttaaggatattgatgtggtggtctccgatttgccggtggggtattaccctgtagatgaacgggcaaagaaatttgcgactgcagccaaaaagggtcattcatatgcgcatcatttgctcattgaacaaagcatgaaagtattgaagccaggcggattggggatgttttatgtaccaagtcgggtctttcagtccgaagaagctgccggtttaaccgcatggctggcggaaaaaacttacttccaaggcttgcttaatttgccggatgacttttttgccgataagcaagcagaaaagagcctgttgattcttcaaaagccaagtgcggacgtaaaacgcgctaagcaagtcttacttggtcaattcccgaatttgaatgatcgtgaggcattcgccgcctttattgcaaaggttaaagactgggctgccgccaatattgcacaatagggcgcggcggcttgtctttgaagactttgcggaaatacaccagatgtgtcgataacaatgtggcgagtgggatcatcgctaaactggctcttaaagggaaaaatcaatcctgcctattgctgattttcagaaatgaatcgttagacgtcagaaaactggcgtctatttttgactcaaaataagttgccgagatgattcttcaaagggcattttctgctttttggggaacaatcaggtagaatagatagttataaacaggaggttggttatgtcgttattgagtattgcttacgtgctcattgccattgttgctgtcggcgtcacgatttttgacattgtgcaggtacggatacgagcgcgtccgaaagtatggcgtattcttttatatctggcagttgcggcgtttagtctggtgttaaccttgcaacaaagccgttcctttgacgacttgattagcggcgggttcattgttgtcatgtttctttgttttgcaagctggcaaaaaggtttagctgatcccgctatcattggtggtttgggtagtattcgcatgtatcagaatctgaccggggttgtgttacaaacgcagcctaaaggaacggttttgttggcacaggcgggaaatctgacggtgttaaaattgcagtttcgtcaggatccgccgaccattaacgcatttttagctgacaagatgccgcctgaccgcattagtattgacgattaggtgtgaatgatttggggttttctgaaaatggtgtataatttttctaataccgcatgctattaatcagacggcaacagctaccttggccgtccgcattagtaagtgtgacgcaaggatagtcagacaatgattagttttaagtttggtttgtgccgttgaatcaagatgaaaaataagtttcaagactgttttatgcttttaaaggaggatgagtatgcaagccgaaaaagatgatcggcctgaactagcacgtcatttgaagagtcgccatgttcaactgattgcaataggcggcacgattgggactggcttgtttttgggctctggtcaatcgattcactcggcaggaccgtccattttatttgcttatttaataactggtggcatttgctttttgctaatgcgtgcattaggcgagttgttgatgtctgatgtggattcacatacttttattgatttcatcacaaaatacctgggtatggatgccggttgggtgactggctggacttactggatatgctgggtagcacttgcgatggctgaagtgacggcgattggattatatattcggttctggttgcctgatgtgccgcagtggctacccggtttaattgctttagcgatcttgttgttgttgaatctggtcagtgtcggattattcggagaagcagaattctggtttgccttgattaaaattgtggccatcattggactcatcgttttaggtatcttcatggtgattgttcgctttaaaacgccacttggtcatgccagtcttggcaatcttgttaacgatggcggctttttccctaaaggcgttggcggttttctcatgtcactgcagatggttgtgtttagttttgtcggcattgaaatggttggcttgactgctagtgagaccaaaaatccacataaggtgattccggaagcgatcaacgaaattccaatgcggattttgctgttttatgtgggggccttgtttgtcatcatgtgtatttatccatggcggcatgtctccccggttaacagcccgtttgttgaagtctttaataatgtggggattccgtttgcggccgatatcattaactttgtggtattaaccgcggcggcctcggcttgtaattcatctatttttagcacggggcgcttgttattttcgctaacgttgaacggaaaaagtcaatcagcgcagtggactgccaaactttcacgacgccaggtgccagctcgggcgattctggtctcaaccggtgtcattgccgtagcggttgtcttgaacctttttcttcccggttcggttttcacgctggtttcaagtatggcaacgatcagttttctgtttgtttggggcatgatcatgttggcacatttgcggtataagaagttgcatccccacagtaccgactttcggatgccattgtacccatttgctgattatcttgtgctgggttttctgctattaaccgcagtaatcatgatgtttgatcgtgcaatgttatcggcgctgatcttcgcaattgtgtggattgccacactctttatattgcggcggctgcggcgagcggaaaaagcagcgtaacgcacattgttgacaggaagaggggctttgcgtggtaaaagttgtgacttatcagcgactaaccgatgatattgtgactgcccctaatcaaaaagatcggcttcctgctaattactgttggaagccgacgttgggttttcgcttcaaagccgatctggtttatgccggtgcgtggctgtttgctcaggggtattggcgcatcggggtgcgtgtgcgtcatcgcagcgttttacgccaggcagccggtcgcggttactttgtttatggcaaccacacgcagccatttggggatgtttttacgccgatgcgcgttaatcaggcgcgacgggtggcgacattagcggcaccggcaaatttgagtgtcccgattcttgggcggttggttccatacggcggtggtctattagtccccaagcagttgcaccaactacgcgcctttcatgctgaaatcaaacggctaattgcggctaaagaagtcgtgatgatctatccggaggctcacgtttggccatattatactggtatccgcccgtttgagtccggtgcatttcattatccggttgaactaaatgcacccgtatttgtcaccaccatgacttatcaacggcgacactggtggcctcggcctaaacgcgttttgtatgtcgatggtccgtattggccggatcagcagctgccattaaaaatgcgccaaaaacagttagcaaccacagtccggaccgtaatgatgaagcgagctaagttgagcaatgttgcctatattcactatcagcagcaaaaggaggcgcaaccgtgaccatgaatattttattttgcggtgatgccaacatgacagatggtgttttgcttgcaaccttatccttaatgcggcaaacgcgtgagccgctgcatatttttgttttgaccgcgacactgacagttaacgatcatcgttataagccgtttccagttgcgaccgtcgcacaaatgaccgagttgatgcaaaaagaaaacccggcgcatcagttcacgcgaattgatataacgaatttgtttgaggcaaatccgccgcgcgctaatctaacaacgatgtttacgccttattgtatgttgcggttgtacgccgatttggtgccacagttaccggatcgcatgctttatctggataccgatgttatttgtcggcggccgtttgctgcgttttaccatgagtccatgactggtgttgatattgccggcgcgttggaccactatggcaaatggtggtttcatcaccggttgatgtggtttgattatctcaattccggcgttttgctgatgaatcttgctagaattcgcgcagatggtttattagcgcgctgccgccagttgttacagcagcggtggctgtttatgccggatcagagtgctttaaataagctggccaagtgtaaacggattctgccgccaaaatacaatgagcagcataagcttgagccggatacggtttttcagcactttacgacatcgtttcgcttttggccgcgttttcgcattgtgacggtcaagccgtggcagattcatgccgttcatcagcagctgggattgcatgaatatgatgatttgctgaaagattatcgccggctagcacctaaattgaaagaagtgtcctaaatgccaactccaaccacggttccaattttcttttccgtcgatgatggctatgttccttgtctggccgttgctttgacttcgattcgggcaaataaaaatccacgtgtcaattttgaaatcaatattcttaataatggcttattacccgccaatcaaaagcggttggctgctttagggacatccaattttgacatccgctttatcacgatggataaggttacgcgacagatcagtggtgatacgaacaaactgcgcggtgattacgtgaccctgaccatttattttcgcttgtttatcgcggatatgtttccacagtatgacaaagcgatttatattgatgcggatacggtggcagaaggcgacttgaccgctttgtttgcaacggatttaggtgataacctggttgccggtgtggctgatccggtgatgatgacttatccggaaaccatgacttacattcaacgcgatttcggcattcagccaggtaagtatattaattccggtgttttgttgatgaatcttgcgcagatgcgtcaggagcatttttccgatcggttcttgcacttgttgaagacttaccattttacgatgattgctgctgaccaggattatatcaatgtcatcgcacaacatcgcatcaaatatttaccgaagctctggaatatgcaaaccggggtccctgcggctgcagagactggtggaaagttgattcactataatttgtttggcaagccttggcattatcatcatgctaaattaggcgatcgcttttggcggtatgcaccggattcgggatttgaagcggaactgaagcagcagttggcggcatttacgttggcggatcagcaggctgatcggcaaagtatgagtgggatgttgcagacggctattgctgtttgccacacggagaatacaattttgaatgccgttaaacatggcgagcaggtggcgctatgaaatcgggccggtttgtcggtccggatcgcgcggcagttgttggcaatattcggcgtgcggtggcggctaaagcgtttaatattaaagtcgaagaacatgatccggtgttttccaagtcggaggagcagcggattgtgacacattacttacaacagcgccgggacaagttatttaagctcaagacactggtttgtcgcttggtcgttaatgcctatgcgttacaggtgaccaaagatgttgaagtagtcggggtcgataaaattcggggcatcaaaagtggcggtgtgattacaagcaatcatttcagcccgtttgaaaatatggctgtgcgtaaagccgtgcatctggcaggtcggcaccgcatgtatatcgtcagtcaggatacaaacttggcaatgaaagggctgctagggtttgtgatgaaatatgatgatacgattccgctgtccggacgccccagtttcttaaatggtccgtttaaacaaatgttgaatgctgcgtttgcgggtcatcactgggtgttaatctatcctgaacaggaaatgtggttcaattatcgtaaaccacgaccacctaagcgcggcgcttatttctatgctgccgaggcgggcgttccgattatctcctgttttacggaaattcgtgatctgccagtccgcgagaatcagcaactgcgcgaagtccgttatattttgcatgttcttgatccaatttatccggatccgaagctttcagcgcgcgacaatagtttttacatgatgcagcgtgattatgtccaaaaatgtcaagcgtatatggccgcttatggcaaaacgttatcctatgcttttacgcagcaggatattgctggttgggatcctaaacagcaagccacagaatagactaaccaaaggcgaacttttctttcgatgggaagttcgtttttattttgtcatttggcgcgatctgcttaatgggtcgaaccaagcattagcgaaaaacggtacttatgtgacaccgatgctgacggcagaatgccacttatagaaaggtacatcaaaacagtttatatgctataacaaaggtgatgtttatcgcggaaaggggaccctaattgatcgatgttactgacgatcatgcttttcatttatataatcaaaagatcagctatatttgtgcgttattgccaaatggtcagttgggccatctctattttggccccagattatcgttaacgactgctgatttgacctatctatcgcaaggttccagtccgtttgcgtggatggctaacttttccgacgatcagccgtttgcattaggtgatgcgcaacaagagtatccagtttatggaactggcgattttcggcaaggcagtttaagtgtgacccaagcagacgcacccgtgtatccgaattttgtatttaaagattatcaggtgagtcacaccaagatgcggaatttacatcatccaacgagctttggtaatccagccctgactgatgttttgacaattcaccttgaagatgaaacggcgcagttattattaacgctgcagtatacgattttttcggatagtgccacggtcgttcgggcagctactttgacgaaccaaggtgctgagccggttatgattgagcggatgttgagcggggcgctgaatttaccccaaggccgttatgatgttgttcacttgtcaggtaactgggccaaagagcggcacattcagacacagcctttgacgcaaggaacgttttcagtggaatctttgcgcggggcatcgagtcatgaacaaaatccgttcgtcgcattgcacgcagccggacaaccatttgctgttggcgatgcttacggtgcgaacttagtctattcggggaactttctggatagcattgaagttaatgaatgggatcagacgcggcttttggctggcattcatccggcttattttagctggcgactagatccgaaaaccagttttactacccctgaagtggtcttaagctttagttcagcgggactagctggtttatcccaagtcaatcagcgttttgtggcccggcatattattgacccgcaatggcgccaaaagccgcgtccggttgttttgaacagttgggaagcgacctattttgacttgaatgaacaaaagctgttgcatctggctaaattgggacgtcaggtgggggttgactgttttgttcttgatgatggctggtttggtacccgtgataatgatttaagttcattgggggattggttcacaaataagcataagtttccggatggcttagggcattttgctgaggaaattcatggcctcggccttcagtttggcctgtggtttgaaccggaaatggtatcgcctcgatcgcaatttttccagaaacatccggattgggtggtccgtcccaagcgcggccgaatgtcgattacacgtcatcaatatgttctggattttagtaatccagcggtcgtaaataatatttttgcgcaaatgcaacgcgtcattaccgaaaccaagcttgattatgtgaagtgggatctcaatcgcagtattaccgaagcctattcaccctacttggcaaaaattgggcatcctcaaggtgaattcttccattgctatgtacaaggtgtctataccctctatcaaaagctgctcacggcctttcctcacctgctgattgaaggctgtgctggtggtggcgggcgctttgatttggggattctcttttatagtccgcaaatctggaccagtgatgattctgatgcgatcgaacggttggcaattcaatccggaaccgcactggcttatccgttaagttgtatgagcaatcacgtgacggcgataccgaatgaacaagtcggacgttccacaccgttggctacgcgatttcgtgtggcagcatttggcattctcggctatgaattggatttgaccaagctggatgatgcggcattggcaacaatcaaaaaccaaattgcttattatcatgaattacagccattagtcttaaatggtgattttcggttgcttttgccacgtcaatccaacagccagaatcaagtagcatggctgctaagtgatcattaccgcaagcgtttagttttaggcttcttccgcgtccttgccgatgcagacagtcgcgccgtgcagtatatgaagataccggttgcccagccaaaccaacgttattgggtgaacggtcacacagggccggtttccggtgatgtcttgcagcgggttggcgttcgcttaccgatccaattcaatggcgctaaccggcaacaagcccaattgatcggtgactatcaatcggccttattgacttttgatggggtaacagcaaccaaaaccggcaagcatcaacctgagattcgcaagcagcagaaggtcggacatgcttgagacgttactacgcggctcggatttagttaatcgcctagtttgaaacttgaacagtaacgaaaaaaagctcgttgcaacgggcttctttcatttcatgatatttgattgtcgccattcaacgacttatgatgccgaatgacggcttttcacgagcagcaagatgcctgaagcaagattcatagcaccggcaatgatgctgaggctgccagcaataattgttatgatactgagtggtaaatggttggcttttttcaattttgacattcctttctagggttgcggtggggtcatagctggcgtaaaaacgatggcgaaggttaatgatttcttcctttcgtttaatatccgtattttaacaaatgtaactgattaaaggtgaagtttatttggtaacgttaagtgagattcttatgaactgaactcactttgaataggacatttcgacagctaaaatcggacactaaatggacactttttgtgcacttcacttcaaaaacacccccaaacaacccaaaataaaaagccccgaaacgctgatttaacagcatttcgggactaaccagaaacaagaaaaagggtcaaaatggaggtgaggagaatcgaactcctgtccatcacccctgctacatgcggctctacacccatagccgatttatttaaaattcgctgcgatgtcgcgccaaccgacaaggctaacacaaggcagctaacctactagtctcttgttgatgcctcaggtggcaacatcaaccgtagctcaatgatttgagacccagacccgacccttgagcgaagtcggaaggatcacgctagctggttattaagcagctaaagcgtaagaattttcgttctttgcagttatattaactgttccgttgatgacggagccgagcctccgaggtgcaccgcatgcgcgaaaagcaatgtcgagaccattacacccccaagaaggtgcaaatgatatattaccacggtataattaaacttgtcaaaacatttgcagttatcattgtactgacgcacacttaggttttaagctatttttatgggggcatgtctatgatcttacttgttgcaggatgcatgcaattactaatgggcatccttcttgctatttttcgaccgcgtcatcaaaccggcctgtggggctacacatcgtatctcgccagtgtcaacgctgatagttttcggttggcacaaaggtggttttatcaggcgttaattgccacaggtgccgttgaaggacttgctggctgggtaattcaccggttagcgtgggataactattttattatctggctttttctggctgttttgttattcttgcccggttttgtttataccgaaagtcgactgaagcattatttggaggcacacgatgcgctgccgtatgattatgttgccccggatgatgcgccaaggcctaaacgccgtaaaggttttaaagatctgtgaaatgagggattcagcagtgaaactattaatgattgaagataatacaagtgtggccgaaatgatggccatgttcttccaaaaagaaaaatgggaagttgtcaacgcctatgatggtgaagaaggactggcgaaattcaaagaggcacctgacagctttgatatcattacgcttgatctgaatctgccgaaaatggacgggatgcaggtggctaaggaaattcggcaaattagcgagacagtgccgctaattatgctaactgcgcgtgataccgaaagcgatcaggttttggggttagagctcggcgctgatgattatgtcaccaagccattttcgccgattacattgattgcgcggattaaggctttgcatcggcgcgccgaggttggagccgaagctggcgcggaacaagcagcgccggaaactaaggcagacgggtttgatgttgaaaccgatcactttaaactcagcacaaagactagggaagcctatttgaacggcaaacagatcgaagggttaacgcccaaagaatttgatttgttgcataccttgtccaagagtcccaaacaggttttctcccgcgaacagctactgcagctggtctgggactatgaatactatggcgatgaacgaaccgttgatgcgcatatcaaaaaattacgtcaaaaaattgaaaaagtcggtccacaaatcatccaaacagtctggggcgttgggtataagtttgatgattcggggcttgatcaatgaaaatgctttatcaacagctgatcggctttttttcggtcatcatggtgacgctggtgatcgtgtcgattctgtttattcgctcaaccaccaatacggtttgggaaaatgggttcaaacaacttgaacagtatacggatgttttgaaaaataacgcggttgatgaaaatacgtatgtcatcaatgcgcggtttattcagaatgccgaagaaattttgagtgaccagcatgttcattttgttatttatgatgcgaataacgttgcaaaatatcccgtttcgcaaaagggccggatgactgcgattaaagcgagttattggaaaaaattgaagcagggatcagcagttgcagtgccggaaatgatgacgaatccgattagcggtagcgcacaaagcatgacgatttattatcagccggttttcttaagtgaaaaactgttatttgtcattgctgcatttgcgccggtagagcagattcaaagttcgattaacaaaaccgaacacaatttgttaatcgcatttgtgctatcaacattagcagctttcatcattagttacttcattgcttcttatcaggttcgtcgcattaatcagttacgtcaggcgacgcatcaggttgcggaaggtaattatgacgtgaccgttaaaatgaaaagccgcagccatgatgaagtggccgaattagcggatgattttcgcgatatggtgaactcgttaaaagcaagccaacaggaaatccaacggcaagaagatcgccggcgtcagttcatggcggatgcagcacatgaaatgcgcaccccgctgacaacgattaatggtttgttggaagggttggcttacgatgcgatccctgaagaaagcaaaggcaaaagtatcgaattgatgcgcaatgaaacgaatcggctgattagattggtcaatgaaaaccttgattacgaaaagattcgcaccaatcagattcttttaagcaagcacacgtttaatgcccgtaaagatcttgataacattaccgagcagctaacgcaaaaggccgaagaagcaggcgataccattacgattaaagcgccagcccaattaccgacctacgctgaccatgatcgttttgtccagattctgtttaacattgtccaaaatgcggttcaattcaccaaaaacgggcagattacgatcggcggtaaattagggtatcaccaaaccgaatttaccgtcagtgataccggtatcggcatgtccaaagatcaaatgaagaatatctgggaacgctattacaaagccgacccatcacgcaaaaatacgaaatacggcgaatccggacttggtatggccattgttcatcaattaatgggcttacatggcggaacaattgaggtggattccaagttgggttcaggaacgaccttcaccttaatcttcccggatgaggcgacagcacctaaacaaaaacagccagcaacaaaatcatcgtcaagcacaacgtcatcgacagccggtgccgccaaaaacactgacgctgcattaaacgaccatcccaagtccgagtaacagtagcttttctggacatgcgggtggatggtgaagcgttaacaggcggtgatatgattgttgataggtaaaagcaatcacatttattgggcgccgatccccaaacgcccctcaagaagtgtgaagcaaacaaataagcactaaaaaggagacccttatgaccatccgacgaatacagcagagtgattttgctgatgtagacgcattattgcataccgcatttagcgccagtaaacgcggctatcatgacgaagcagcgctcgtagcagaattgaggcgaaccactgattatgaagcggctttagaagtcgttgccatgattgatggacatttagtcggctatgggctcatgacggcggcaacgattacgccggatgcgcatatgaacggagtagcactttggccgttagcagtcgcaccggcgtatcaagggagcggtttaggcatggccattgtctctgagcttgatatgcgggcaaccgatctacgccgtgattttgtcagtgcgattggtgatcgtcaattcttcggccggttcggatttcgtaaagcagccgcctacaaacttgaaccgccgttttcaatcgttgccgaagatcatctcattaaggaactcgtgcccggtgttctagccagtgtgcacggaaaagtcaattatgcacgcccatttcttgccaaaatgccgaactagacaaattaattgaatccgttgataagttgcaggttactctgcagcttattttgctggtcgttgccttcaaacattacttttctttgtggtgggctgattgatgtgccttatgtaaggtgccgatacacaggccgccactgaccaaagcaccgcccattagtgtgttgtcagtgacatgtggccagtattctacaaagatgacgaaaccaatgataatgactgctgtcaatagttgccatgacagatgatagggttgccgtgccttcatttaaaagccttcttttttgggtcttaactaactgattgtgtttcgaaactagcaggtgtggagtcctgacgcgtggaaattttccaacctttacacgcaggtttctatgcccgtcaatagcatcatattttcttaataaaaagtcaccatcagcctactgcaaaaatccttgagtttaaagcccttacctgtgagttgctgtgatgatcgttgcatatgtgtcaatttaacgattgattcggttgatgattcatggcctggcgaaatcttttaaacaacagggtttattaggtatcacaacatgtcaagtcggttacagtttaacgattactttgcagaagtgacaatgactgttacaatatgaacatattcaaacggctatcaggtagttcgtaaggtgtggtggctgtcaattattttggggggattttgcgtgaagcagttttatattgttgacagttcaattcttccagacgtggttggcaaagtgattgccgcacgaaccttactccaaaatggtgaagttaaacaggtcagcgaggcagttaagcaagttggtatttctcgcggcacctattacaagtacaaagattatgttttcctgcctgatcatgaaatggcatcgcgaaaggcagtcatttcattaatgctccatcacgatcgcggtattttgtcagaggttttgacggtcatatcgcatgcacaggccagcatcgtgacgattaaccagaatattccaatccataattgggctagtgttgtgatctcatttgatatttcggcactgcaagggaccattgatgatttagtaaccaaacttggcgatattcgcggcgtcagtgatgttcatctgatttcggtagaataagcggcatgtttttttggaggctttatgaaaatcgcatttaaattattgctctgggtgttagtagccggagttgctttatttccggcgctattattgattttgtttgtcattggcctgagcgttgttatttcgggtgctttggcagtcagtgccgttggttttgtaatgggcactatttttgttgcattggtagggttgggcattatgattccaagtgtcctgctcattattcgatttatgactttccggacagttaatgcccgatttcagcgcggcggtgaacgcttagtccttccggtgagggttcatttaactgggcgcgcgatctaccatgctatttatgaaaattacaaagctgggcgtcgtcagggaaaacatgtttttcaagcgtggagttttggtttagagacgtattttcatgaagatcttcaagcgtatctggcagaccagattctcgcgcaacacggtccggagatggcagaggcttttgtcttagataaacgtcattcatataccattgcttattaacaaataatcgaaggtaagttcaccgttttgggatgttctcaaaaccggaaatagcatgtttaaaaaattggccttagcgtttaacaatttcagttgcgctaaggtcttttttcagctaatgggtccagtaaaacgaagcactaaaccttggtaccgttaccaatcggcatgataaaaagtgtcggatcgcttaattgggccacgtttcgtctgcacgtgggcgtcgttgaatgagccgattggttcgcggccagcgcagttcctcgaaaccgatgaattcaatggttaggcgggtctgttgccgcagtaagccgataaaaagctctaattgcgccaaatcatagttgtgcaggctgtgcaaggggatggaacgcaggcgttgatcttttggttggatgttaaaaaagaagttaaatgccggcgtgtaggtctggttgacaagtgaaatccagtaccgtgtcttccggcgccgtttaaataacggggtcaatcgttccatgataatcttgagatcgttagtcatagctattgccaccattatggcctcctacaagtgatgcgcgctgaatggcggtaccgccgtgcatggcgcttttggcgtagacgagtgctttaaagccgaatcgattgcggatcgcatcaagcgttcgttccaagtttgttgccttgatttgctgatcgatcggttcaaaaaaattgagttgttcgccggtgtccggggccaagcgggaggtgtagactgccacattacgaacgacttcgccatgccagttatcgcgaaaaatttcgcgtaaagtcgtcacgatatctgagtcgcgatttgttggcagcattcgtttagcttgtgaaaacccagtgcgaccgtctgcttggctctcagcgtatgaaaagccaattccaagtgtgatttcaccggcccgtttgcggtgatgacgcaagcgggcggccacttgttcgccgatttccttaatcacaatttcgatttcgaactgattacgataatcgcgtggcagcacttgagaattaccgatacttggctggcgcgtgacgatccgctgactaatcttggtgcgatcaatgccccatgcggtcgcaaaaagctgcgtgccaagaatgcccagctcttgttttaaggcgtacggattggcgtgagcaagttcatacatacttgtgatgcccattcgtgctagatgtgcggcggtacggtgaccgatgctccagacatccgtcatattcttgattcgccagatagtttcaggcacggttgcatatgtaatttcgccgagtaaatcggaattgtacttggcgtatacatccagtgctatcttggcctggactggattctcacccataccgacagtggtgcgtaaaccgagctgttggtgaaccgttgcctgaattaacttggcaacggcgcgtggtgtcttgccaaaaagtcgccaagtatgggttaaatcgagaatggattcgtcaatcgagtatggccataaatcttcatcggcaacgaactgacgaaaaatgtcattgatagccagattcttcttaatgtaaaggttcatacgcggaggcacgacaattaaatgtggttcattaggtaaatcgcgttgccggctgacgttactcttgagaccatacatttttttggccattggcgacgtggctaaaattaaaccgccgttcgtattttcctgttcggacatcaccacgagaacggttttgagtggatcaagtccacgctcgatgctttcaaccgatgcatagaaggacttgttgtcgatcaaaaaaatgacgcgatgcggttcatgcgaatagtcatagcgcatatcaatcacctctgtagctattatacgaacgtatgtttgcaaaggcaagttattttctgcttacgttgacaatgcacaaataaaaaatccacgctgcctggaaaaagacaccgtggatcaaaagtttattggttgaaactattaactgactaacgcatgcagccacccatatgccaggatgaagcccaagatgtaaaaccgtgcatcatggtatcaggggcaatggctgtccagccgtgggtaacgaatgctaaaacgaataaggcggtaaagattgctgcgataacactcaaagtaacgattaaaggccgccatttttccgataacatcatacttcgcctcctgctattgaatgttaacttctgccattagtatagcaccatgaacttaatagccaagttaagctgcaggcaacaccgtcgttcagcatgatcgaaacggtgaatcaatcacgctcccatttgatcttgaggttggtttcgattaagtcgccatcatcgagtgcaaatggttcaaccacgctggtgccatctggtttcgtgaatttgatgtttaaaatattatcatcgcggtaaacgacctcccaagtaccgttgcttggggtgttgttgttagttgctgtgtatgtgccatcgctattgaaattgaacgttgcccgatcgccggattcccatcggccaacaataccgctgattgagtgattatcgttgcgttttgaggtgtcagatgggtaggtgcggttggttttggtcacgccattgtcgtcatagtcatcatcatcgtcgtcatcagtgtcacgacttgtttgtgaagcctgtgacgatgaagaggcggtgttggacgaggcagctgctgcgtctaaagtgagtgcagcggcttggcctttcaggggaacgatcacgtcgcgggtgaaatctttagttgcaccgtcatgcgtaccgctaagcttaagggtatagcgtcccggaagttgattggcgatcgtgtattgaccattatgattggcagcttgcaccggcgtttgattcagcgttaacgctgcgtttttaaggttagtcttcacggttaccgcggtggttccaagcttgactttatacttcgggaaaaacaacatttcctgaccttgtttgactacctgaaccataccgctagtggacttagcccgaatcaaggtatttaaaaggctgcgataatggcgatcctcaatgagttgggccagtggtttgaggtcatcttcatgcaaaggcgttccatcgctggcaacggcaacttctgccatatcatcagcatcgccgcttgtcatttcttcggcaagctcggcaacttgccggtcttgactataataggcggcgccggctaaataggcacaaccggctattaagatgacgacaatgccgacaatccatggccagcgccgatgtgagtgcggcgtatgtcgggttggcgctggggctgctgcagttgttgatgcaggggtcgttggcggttgcggcgtggacgcttcgttttcgcttgtttgctgcgcttgcaggcgggctgaccgtaaatcaaagccgcagtttgggcaaaagtcatcgttcggtttaatcggttgcccacagttaggacagaattttaacggtgtttgcatgtatcattcctccaaagttttaatgagttgagcagcaatttgatcatggccgcgttgattagggtggaacgtatcccgggggccattggcagtgaaatccggaatgacagtgccagccggtccggtgacatcatcatgaccttgccagatggttgccaagtcaacgaccggtacctggtaggtttggcccactgctttaacaacggcatcgaatttcaagtcggcattaacgtagggcccttgatttggtgaccaggttgtcatgaggatcagttgtgccgaggtttctttttgcaacgtggtgacaatggttgtcagtgcttgttgataggcagcgagcgcagttgaggttgcgccaccgacagcgtcattggtgccaaactcaatagtgatcacatccggatgctgggcaacgagttgcggtaaagcggggacgcccaagttagtagccgtttttcccacttccgcaatgccggcttcggtgacggtttttccggttaatcgggccagctgccgggcaaaaagcgacgtaaaacgagtggcttttttatcggcaaaaaggccaacggaaagactgtcgccaaaaggagcataaaccagttgtgctttgcttttggccttcaatcgtgctaatcgagtcgggcgcggcggcgttgaagcggcgctggcctgacgactgcgagccgatgcagaggggtggcttgttgatttagcagcttgccgcgaaaccccacagccggccgctactaacaatagtaaaacacccaatcccaaccaaatctttttcatcccaatacctttcttgaatcgactgatgacatgctggttataaatagtctttagctaacaaatcgggtattgcgcgctttccaatcttctagcttgataaagacccagaaactgtaaatgccaagcgtgatgatcgatagcagcagccacttaatccaattgccaaataaaccgacagcggaaccgtaaaaatgcatccgatggccttcaatcacggtatggttgatcttccagccatataacatagtcaacgcccaaggatagcagatgcccagtgtggcgatcgtaatcaccgcaccgagaatcgcccagccaatataggccaataagccgccatcgaaaaaagaatttcgtccatttctcatttccataatcgttgcatcctccaacttctttacttaagtgtatcagagtcatcgggcaacgcaatgaatatgcgctatagtgagcgcgagccggcgcggttaggagtcggagtgtaagtggccttgggcgtgatgacccggtcttggtcattgcgcccaaggtccttacacgcagactcctgcgccggggagcgcgttatgggcataaaggagaactagtggccttgggcgtgatgacccggtcttggtcattgcgcccaaggtccttacacgcagactcctgcgccggggagcgcgttatgggcgtaaaggagaactagtggccttgggcgtggccattgcgaccaaaagccctacttacacgcaagcccttgcgccggagaacgcgttatcgtgattgtctgtctcacgcttaacgccaaagtttggtacaataggtcaaggaatttttcacttggcttttctgaaaggacgattcgttaaatggtaatggatgccgcattaaagggtatgaatgataagcaggcagaggcggtgttagccactgaaggaccggttttgattatggcaggggccggttctggcaagacgcgggttttgacccaccgaattgcttatttagttgaagaaaaaaacgttaatccatggaacattcttgccattacgtttacgaacaaggctgcgcgggaaatgcgggaacgggtaggtaaactggtcgatcctgagattgcccgcgatatttgggtttcaacgttccacgcattgtgtgttcgtattttgcggcgcgacattgacaaactcggttacaatcgggcgtttatgattgctgatccagccgaacaactcactttggttaagcacattttggccgacttcaatctggatcccaaacgttatgatcccaagtcgattcttggcgcgatttcgggtgccaaaaacgaactaatcgacccgcaaacttattcagacgagcaggccaacagcccatttaccaaaactgtggcccaagtttatgcggaatatcaaaaacgcctgcgcagtgatcaagcattggactttgatgatctcatcatgcagaccattgtgttatttgaaaaggatcccgaaacgcttggcttttatcagcgtaaattccggtatattcacgttgatgagtatcaggatacgaacgaagcccaatatcgcctcgtgcatatgctggcggaaggttatcacaatctgtgcgtggtcggggatgccgatcagagtatttacggttggcgtggcgctaatatgcaaaacattctggactttaaaaaggactaccctaaagcccaagtcattttgcttgagcagaattatcgctcaaccaagacaatcctgagtgctgccaatgatgtgattaaaaacaacttgaatcggcaggctaaaacgctatggacggaaaatgccaccggcgacaaaatcacttattatcgggctcaaagcgaaaccgatgaagccatttttgtgattcgccgcattgaagcggaaatggcagaacatcaccgcaagtacggggattttgcgattttatatcggacaaacgcccaatcccgtgcgattgaagaagcgttcgtgaagtccaacattccttataaaatggtgggcggacataaattctatgatcgtaaggaaattcgcgatgccttggcttatttccggttggtcgtcaatccagctgatgatatgagctttaaccggatcgttaatgaacctaagcgcgggattggcaatacaagtgttgctaaactggaagcctttgctaatcagcatgattggtcactcttggaagcagcggcaaatgctgagcttagtccgatttcaggcaaagcccgcggcaatctagccaaattcggtaaaatgattcaacgacttggtcagcggcggaaagatttgaacgttacggaaatgatgcaggcaattctggatgatagcggttatttagggacgttacgtgccgccaacaccttggaagccgaaacgcgagtggaaaaccttgaagaacttttgtcagtgacccaaggatttgatgcgcgctaccagccggaaaatgaagacagtgatatttttgtcgactttttagctgaattggcgctgttgtctgatcaagatgaagttgaagaagatgcccaggaagtgacgttgatgacgttacatgcggctaaagggctggaatttccagtggtctttctggtgggcatggaagaaggacttttcccgttgagtcgcgccgctatggatgaaggcgagcttgaggaagagcggcggttggcttacgtcgggatcacccgagcaaaacaaaagttatatttgaccaatgcctatgcccggatgttgtatggccagcgtcaaaataatccggcgagccgttttattgaagaaattgatcctgaattgcttgatatttccggtgctgcccagccgaaaagtgatataccgttcatcaaccgcaccgatcgcgcctttagttcgccttatagccgtcatcctgaaaccactgggacgccggtaaccgttaaaccggctccaaccactggtgccggcaagacaagctgggaagccggcgataaagtcgaacaccgtaaatggggaatcggtaccgtggtcaaagtaaccggcaccggtgacgatcaggaactagatatagcctttaaagcgatgggaattaaacggttattagctgcgtttgccccgattaaaaaagttgaagcctaatgatgcatgaaaggttgttaaccgcgtagtgaataaggaggttcgccgtgttaagtaaaccagctgctcaatttacacttgaagaagccgaagccgagattgccaagcttcgaaaacagttaaatcaatggcgcttggagtattacaccaaagacgctccaacggtcacagataatgtttatgatgatcattatcgtgacttgcaagcgttagaagccgcttttccaaaactggtgacgcctgattcaccgacgcagcaagttggcgatgtcattaattcggattttgccaaagttcagcacccgattcccatgctgtcaatgggcgatgtcttttcatttgaagaacttagcgaatgggatgcgcggatgcaggctaatgtggggcatgcggttgattacaatgttgaattgaagattgacggccttgctttgtcgcttatttatgaaaatggccgcttagtgcaaggctccactcgtggtgacggtaatgtcggcgaagatgtgacaaagaatgttttaaccattgcttcggtgcctaagaccttgaagcggccactatcgcttgaagtgcgcggtgagtgctatatgcctaaagctgcgtttgccaaattaaacgcacgcaaggaggcagatggggacacgccatttgccaacccgcgtaatgctgcggccggctcgctacgacagctcaatcctaaaatcactgccggacgggaattggacacgtttatttatacgttaattgacgccgatcggtttaatgtcaaaacccagcatgaggcgatcgcatttatgcaggatcttgggttcacaaccaatccaagttccgaagtggctagcgatatgcaagcgattgatgcctatatcacgaaatacaccagcgatcgggatgctttgccgtatggaattgatgggattgtgctaaaggtcaatgacttggctttgcaggcccaactcggaaacaccgtcaaagtaccgcggtgggaaattgcctataagtttcccccggaagaagccaaaacggtgattcacgatatcgtgtggacagtgggtcgaactggggttgtgacgccgactgcggtgatggatccggttcagttggctgggacaacagtcgcacgggcaacgttgcacaatgccgacatgattcgggataaggatatccgcatcggcgacactgtcatgttgcataaagccggcgatattatcccggaagtttcacgcgtcctggttaaaaaacggccagccaataccccaccagcgccgattccggaaaaatgcccatcatgcggccaaaaactggttcaccttgatgatgaagtggcgttacgctgcatcaatccgatgtgcccggcgcaagtacaagaacagttgacccattttgcctcgcgtaatgcaatgaatattgatggattaggtccgaaaatcattgctcaactccaggctaagaagctcgtgacggatgtcgccgatctttatcgactcacggccactgacttggaaaagttggataagttcaaagaaaaatcaattaataatttgttaaatgcgattaataatagtcggcaaaattctgtcgaacgcctaatctttgggttgggcattcgccatgtcggtggcaaagcggcacgtattctggccgagcattttggcagtttggatgagctcatggcagccgaccaagaccaagttgcggcaattccgaatatcgggccaaccattgctgaagcggttgtcacctattttaaaacggatacggtgaagaaattggttgaacaattgcgctctgccggtgtcaacctgcgttataccggtccaacccgtccggcagtaagcgatagttttgtttctggcaagaccgtggtgatcaccggcaagtttgccgagttctcccgtccggaattgacaaaacgcttagagcagttgggtgcaaaagtgactggttcagtgtcgaagaaaaccgatctcgtcattgccggggatgcagctggtagcaaactgaccaaagcacaggatttgaatgttccaattatggatgagacagcgttgttgacgaacttgaagaattgaggaacttcatcaatgaagaaattttttacgttaaccttactgacaggcgccattgtgctgttggcggcgtgcggcaagctaaatcttgacagcggcagcagtagcaccggtggaaccaaaaccggcagctaccaaacgactggaacggttgataatagtatgtaccaaggcgtgatcaagaatggccgctatcagaccagcagtgcacgtggtttgatgctgcaacaaaacgatcaaggcgaaaatacttttaacatcaagagtatggaaagtggcttggagagtttggccaaagcccaattttcaacggataaatattcgtttgaagaagggcagttattgagcacggcaacagcaagaagttggcttaagcgggagtcaaagagcaatcccgatggcttaaatccggttgataacgggaagaaagatcctgatacccgtaatccgatgtatctacagcagattctggaacaggacttcatggtgcaagacggcaacagcatgaaactaggcgggattgcgattgcgcttggcatgaatcaggtcgattactacaccaagaccgaatatggtgcgcaatatcaaaccgaaatttccgaagcaacgctgaagaaacaaggtgaggccatggcagcaaaagttgtcgcgcgactacgcaaaatggaaaaggtgccgagtgatgtaccgattttggtaggtatttacaaaaacgccgaacaagatagtctggttggcggcgtttatgtcgaacacgcgaccagcaagagtggaacggatctcggttcctggaagaaacttaatcagcaaaatgaaattctgccggttgtcagtgaccataaagcgattaacagtacggttgccaatgacttttcgagttttacaaatcaggtaaaaggcttcttcccgactttagcagggatcacggctcaggcgcattatgaagatggcaatttaagcggcatgaagattaccgttaacactcagttctatggcttgacggaaatccaaagtttcacgcagtacatttcaactgccgccaataagtatttgccatccggtgtgccaattgaaattaccattcaaagtacccaaggcatccaggcatttgtctcgcgaagttctggggacaaaggcttttatacgcatgtatttggaagttattaaaggaaactatggtaaactacgaatgataatgaaaatgaaagcggggatagcatgatttcaaaagacagtgtggcacacgtggccagtctggctaagctgcaattttccgaagccgatttggagaagtataccggtcagctttctgaaattttggatatggttgaacaattggaaagtgtttcaaccaaggatgtaccagtcaccacccaaagcattcatcttgagaacgtgatgcgtccggatgttgctaagccgagcgaaccagtcgccgaattgcttaagaacgttccgactaaaaaaggaacctatattcaagtgccggcgattattgacaaggaggaggactagggcgtggattattttaaaacgaatcttgatcaacttcatgaacagttacgttctggcaagctgaccagtcgccagttggttgatgagacgctggccggtatcgataaaatcgatccggaagtggccgctttccttgccataaatgcggacggtgccaagaagcaggcagccgtaattgacgaagccggtattgccgatgatcagccgttatccggggtgccgatcgcgattaaagataacatcgtgactaaaggcgttgtgacaaccgccgcttcgaaaattctggaaaactttaatcccatttatgatgcaacggtgatgcagaagctggccgctgccggtgcgattaatgtgggtaaaaccaatctggatgaatttgcgatggggtcttcaactgaaaactctgctttcaaaacgactaaaaatgcttgggatcacagccgcgttcccggtggctcttcaggtggatcagcagcggctgtggcggccggtgaagtgattgccgctttgggtagtgacacgggcggttcgattcgccagcctgctgctttcaacggcattgtcggctttaaaccaacgtatggtcgggtttcccggtgggggctcatcgcgtttagttccagtctggatcagattggaactttgacgcgcggggttaaagatgccgctcagattctgaatgtgattgccggacatgatgaacgcgacagcaccactgccgatacgccggtaccagacttcacggccaaaatcggacaatcgatcaaaggcatgaagattgcgttgcctaaagaatatctaggtgaaggggttgaccctgaagtggcagctaaaatcaaagctgcagctaagcaacttgaagctttaggcgcaaccgtgtcagaagtttccttgccacacacccaatatgccgtaccgtcttattacatcatcgccagttccgaagccagttccaacttacaacgttttgacgggattcgttacggcttccgcgccaaagatgtccacaacattgaagatgtctatgttcgttcccgttccgaaggctttggacccgaagtaaagcggcggatcatgttaggaaccttcagcttgtccgctggtttttatgacgcgtacttcaaaaaagccggtcaggtccgcacgttaatcactcgggattttgaagctgtcttcgaggattatgatttaatcattggaccgaccacgccaactgttgccttcaagattggggaaaaagtaaccgatccggttaccatgtacatgaatgatattttgacgatcccggtcaacttagctggcttaccggctgcctctgttccggctggatttgttgatggtttgcctgtgggcttgcaactgattggcaaacatttcgatgaaagtacgatcttccaagttgccgcagcttttgaagcgcaaaacgactacttagcacagatcccgggaggcaagtaagatgaattttgaaacgacaatcgggcttgaagtccacgttgaattaaaaaccaaatccaaaatgttctcaccagcgccagtcacttacgggcaagagccgaataccgagaccaatgtcattgactggggctttccgggcgttttgccaagcatcaaccgcggtgcataccaacttggcatcatgttggccttagcgttgcatgcagatatcactcggcagacgcattttgaccgtaaaaactacttctatccggataaccccaaagcttaccaaattacgcaaagtgaaaaaccacttggcactaacggttgggttgaaattgaagtcggcggtaagaagaaaaaggtcggcatcgcggaactacacgttgaagaagatgccggcaagaaccaacatgaagacgatggttactcttatgtcgacttaaaccggcaaggcacgccgttggttgaaatcgtctccaagccggatatcacaagcccggaagaagcatacgcctaccttgaaaccctgcgccaaatcgtgcagtttaccggcgcttctgatgtcaagatggaagaaggctccatgcgggtcgacaccaacctatccgttcgcccaatcggacaaaagcattttggaacgaaaaccgaaattaaaaatttaaactcctttgtccatgttcgtgatggtttggcatatgaagaaaagcgccagcaagcagttttacttagcggcggtgaagtacgtcaggaaacgcggcgttgggatccggatactaaagagaccattttgatgcgggttaaagaaggcgccgatgactatcgctatttcccggaaccggatttaccgccagttacggtttcccagcagtggattgatgaagtgcaggcaacgttgccacagccaccggcagaacggcgtgagcactacattaaggactggggcattccggcctatgatgctggcgtcttgacgcaaaccaaggaaatgtctgacttcttcgaggccaccgttgcccaaggtgcggacgccaagcaagcgtctaactggttaatgggtgaagtttccggttacctcaatgccaaacacacggagcttggtgacgttgcgctgacaccggaacacttagccggcatgatcaaactcattggcgatggcacgatttccagtaaaatggctaagaaggtcttcaaggaaatcattcagcatgacaccgatccggatcagtgggttcacgaaaaagggctgatccagctttccgatccggctaagttgaccccgatcattaccacggtattggacaacaatcagcaaagtatcgatgactttaaagccgggaaagatcgtgcaattggcttcctggtcgggcagatcatgaagcaaacccatggtcaggcgaaccctaaagttgtcaatcagattttgatgacagaaatcaaaaagcgttaaaggcatttattgaaaattgtggtacggtattcattgaccacatacgattgcaaccgattgacggcggtccgtggtacaccattgggccgccgtttttcgggtattggtcaggttaagcatgcttagaatgtgatgaccttagaccacgtgaaaagaacccgcaagtcagttggatttggaattggcttgtgcattgaaggagcagagagtcatgagaaaacgggcgcgcttgatttacaacccgacatccgggaacgaaggattaaaacgtttcgttcctgacattttaaacatcatggaacaggcaggctatgaaagttcgacctttcaaacaacgccaaagcctttttccgcgcgtgaagaagcaaagcgggcaaccgaagccggctttgagctcattgtggcagcaggcggcgatgggacgatcaatgaagttgtcaatgggattgcgccagccaaaaaacggcctaaaatggcgatcatccctgccggtacaacgaatgattatgcgcgggcactgcggatttcccgtgatgatccggttgaagcggcacgggttattttaaaagggcaaactttggcgatggacatcgggcaggcgaaccatcattattttatgaacatcgcagcaggtggtttgttaagcgaattgacttattcggtcccatccgaagtcaagtccatttttgggtattttgcttatgtcattaagggcgccgaaatgttaccagcggtccggacgatgccgatgaagcttgaatatgatggtggtgtctatgacgggccagccagcatgttctttcttggtttgaccaattcggtgggtgggtttgaacaaattgtgccggatgccgagttgggtgacggtaagttctcgctgattattgtcaagactgccaacatggccaatttgttgaaattgatggcgcttgtcttcaacggtggacgccatgttgacgatcccaatattgtctataccaagaccaaaaagttgaaagtcaaaaccagcggccaagacacgcttaagatcaacctggatggcgaatatggcggcgatgcaccgatgacttttgttaatttaaagcaacatatcgcgatgtatgctaatgtagacgagatcccaaccaagaatttagggacggatgcccagaagcaaagagactacatggcagaagtcgaatcgatctcccaccgcgacattgatggcgatggtcaaatcggcgcacaagatgaaaaggatgactaatttggcccaaccagctgttaccaagaatcaggatctggaagttacgattgaggatctcacttatgaaggcatgggcgttgcgaaagtcgcgggttttccgctatttatcgaagatgcgctacctggcgaaaagatgcaggtacatgtgcttaagacccagaagcaatacggttttgccaaagtggtgaagcgactgaccgactcgcccgatcgcgtggccggcgctgatagtacttacattcgcaccgggattgccccgttgtcgattttggcttatccagcacaattaaaattcaaacaacatcagatccaggaactctataaaaaggcccacttggcgatcaaagtgttgccgacaatcggaatgaagcatccactaggttatcgcaataaagcgcaagtgccagtgcggttggttcgtggcgaacttcagactggtttttataaaaaacacagccatgacttagtgccgattgaggactttctgattcagaatcctaaaatcgatcaggcaatcgttgtggttcgcgacttgttacgtaaataccgggtgccgccttatgatgaacgtacgaaccgcggcgtgattcgtaatatcatggtgcggcgtgggcgggcaacgcaccagatgatgatcgtgttggtggcgcgcacatggcaagtaccgcatctgaatgatattgtcaaagaaatcacgttggctcttccggaagtcaccagtgtggtggttaacctgaatgataaacgtaccaatgtgattctcgggcgtaagtcaaaaacaatttacggtcgcgactatcttttagacaaactattaggtagtgagtttcagatttcgccagtcagtttttatcaggttaatccgattcaaactgaggtgctttatacgaaagccattgaagcagcggggttaaccggtaaagaaaccgtgattgatgcgtattctggcattgggacgatttccttaaccatggcgcggcacgcaaaacaggtctatggtgtcgaagtcgttgagtcggcagtgcatgatgccgaggcaaatgcggcgcgtaatcacatcaaaaatgtgacgtttgaggttggtaaagcagaggacgtcatgcagaagtggaaggacgcggatctacctgtcgatgtcctaatggtggatccgccgcgcaaaggcttggataaaacctttattgacgcggtggggtatatgaagccgccaaagatcgtctacatttcctgtaatcccgctaccctagcgcgtgacttgcagttgctggcagcgtttggttatacagccaaagaaactcagccggtggatatgtttccgcagacgcagcatattgaaagtgtgacattactcgaaagtatgagagaataaccaacaagtgttgatataacagtggctaaggatgattttaagtataaaaagctcatatgataatcatgatcagtataattttacgtttccttttttctttagtatacgatgaattagaatagtactttgagtgggttagcatttcatttaattattccagaaaatggatgcgatagaagtcacgttaaatactgatacagcaagtgtagatcgaagttattaaaccgaggttgctgaaaagtcccaaatcgtaaatttgataatcccaaatcccaattatctccaataatcgtccgtccagtggggaacaccactcgcaaatcgatctgttatcaaggtatttggagggcccgtttttacgagatttagtttttcagcagcctctattaaatcagtagatttttcgcctaataataactaaacaaaaatggctataacaagatacatcacattgaaggaaagaaaaccacaatatataactaacgaaaagaagatggattaatcataatattatcctaaaaaataatacggagcatcaataataattgattctattaattggcaagagtttaagaacttgcttgcgcaaaaaggcgcggatgttgctactgatgttttgaggagggtttcacagagccatagtgtgcaatcttttgaaaatccgtaaagccatacgacttaattcgaaataggagaaagttaatgcaaactgataatgaaaagtacaatgaaaaggcacagcctaatactgcctttatgaatgaactgaagaataaactgccagagttttttacgaaggatggctcttttgatttggaaaaatttgtgggacagttaaaagacaagaatgttgatgaactcagtgaagggtatcagctagtttttattggtaagaactatgcacgtcgtcaggccggtgaaatgccaaggacggtgattgttcccgatgaacagcaaaataaaaatgagggtaagaacagtaaaaaccttttttttactggcgacaatcttgaggtactgcggcatttgcagaacaattaccagaataagattgacgtcatatatatcgatccaccatataatactggtagtgatggctttgtttacccggattcttttgaatatagtgatgatcaattggaaagaatgtttgatattgacgatgatcaggtggaacggttgaaaagtatccagggtaaatctagtcattcagcctggctgacctttatgctcccaaggttaatactcgctaaaggtttgttatctgatagcggagtaatttatgtttcgattgatgataatgagcaagcacagttaaagttgttatgtgatgacatattcggcgaaattaattttctggctgatgttatttggaagcatacgcagcaaagtaagaacgatgagcctttctttgctagaatgtataaccatacattggcttatgctaagaacataaataaattgaacccgttctttttaaagagaacatcaaaggataatataaactattcaaatccagacaacgactcaaatggagcgtggagagcaggagatgttaggagcccaaacctaagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcataccgtctaccgctattacgatatgtggcgagataaaccagacccgacagctgattcgctattagaaaggcttttaaaaaaactgtcgcttcctatcgttttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaacggtttaccacaagccattctcgtgacacgagctaatgtatcagatcgttcaggtgcattggctatgtttagtttggctagccaaaatttagagctggttcagcatgtcatggttgatggtggctacactggcaatgactttgcggatcaggtgaagctcattttgaatgctaagacgacggtagctaaacgcaacgagttgcatatgttcacggtgttaccgcaacgatggatcgttgaacgttcatggagttggctagacaaatgtcggcgactttggaaaaactgtgaacgtgcccttaacagcagtcttcaaatggttgtattggccttcctgaagatagttcttaaaagatactagacaggttctaagggcaacattacgatataatattactgctcccaatggaaagaccatttttccacctaaaaatgggtggagatggtctaaagatacaattaatgaaaaaatcaaatctggagaagttgtttttaagcctgataattctggaatcatcagaaaaatttatttatcaagtcaaaagggaagaactcccgaaaatatttgggcgaatggagaagccggaactactagaagtgccacttctttattgaaagccttgtttgatggtgtttctccttttgggacacccaagccggtggaattaattaagagatttttagagttacaaaatgacgatgacgctactgtacttgatttttttgcagggtcttcaacaaccgctgaagctgttatgcaattaaatgtcgaagacggcggtcaccgaaagttcatcatggcccaacttcctgagaagacttaccacatcaataaaaatggtaaggaggtccctaccaagggtggcaaagcagcatatgaatctggctttaaatctattgacgaagtttcccgtgagcgcattcgtcgtgctgccaagaaaattagggaagataacgagctgaccttgccagaagactttgatggtagttttaaacactatcgggtcgttgaacctgttaaacagacactagaagaaataggtggattcgatccaaacaacctcaatctttttactgacatggttgatagcttttcaagtgagagtttaggtgtggctggagatgcatctggtacaaagactattttgacgacttggctggcaaaagatggttatccctttgatgcctgtgttcagggcgtaaattttggtaattatacagcatatattattgatgataaccgtctttatttgattgaggaaaactggggtgcaaaacagactaaagaattgctgaatcagcttggtactcatcatttagaagtgcaaagcgtcgttatctttggatactcctttaaactagccgcattgcacgaattagagattggtttgaagcagttagacaacaaagtcactttaatcaagaggtactaatgttatgaagattaaactagaaactttgcaacaccaaactgatgctcttacggccattaataaggctttcccaggcttagataccacgagcaatgatccaaatgctgactatatctatgccaatcctttgattaaatatcggtataacgataaagcaaatatcgacattaagatggagactggaactggtaaaacctatgtttacactagaatgatgtatgaccttcaccaaaagtatggattgtttaagtttgttattgctgtgcctagtcccagcattaaggaaggtacacgtagttttataagtagtgattacgcaaaacagcatttcagcgaattttatgagaatacccgagttcagctaaatgtgattaacgcgggtgattttgttatacgttcggggcgacgcaacttccctgctcaactatctgaatttgtggaagcaaccaggcaaaatactaaccaaattgaagtattgctggttaaccaagggatgttgcattccaagtccatgcacaatgatgactacgaccaaactttattaggaggtgaaacatctcctattagggctattgctgcaactcgaccagtagtgatcattgatgaaccacaacgctttccacgaggcaagaagttttatgacgatattgaagatatgaagccgcaattaattgtacgtttcggtgctacctttccagaaaccacaaccggtcgcggtaaaaacaaagtcaccaaagtcgattattttcgaggcgagccacaatttaacctcaatgccgtagatagttttaaccaaggcttggttaaaggaatcgatattgattatcctgatatgtcgaaagagcaagccaataacttgtacaaggttaaacaagttaaggctaaagaattaattctgttcaaagatggcaaggactacttattaaatgtaggtgaaagcttggctgatgtggactctggttttgaaggcaatatcacctatgtcggtggaactgatcgtgaactttccaatggtcttgccgtatcaaaagatatgaaactgatccctgggacttttgcaaaaaattaccaggatgaaatactctcccaagcaatcgattgtcactttaaggctgaaagggaaaactttttgcgcttgaattcgggaagtcacacgccaaagattaagaccctttccctattctttattgatagtatttctagtttccgtggcgaaaacagcagcaaaggctggctagcaaagcactttgaggaaattctaaagaaaaaactcacaaaactaattgatcgatacgaattggccattgatgatcgcgaaaaagaatatcgttctttcttgcaggccaccctaaagagcctgcaatcagaacatcaagacgtttatgctggttactttagtgaagaccgaggtagctcgaacgcagatatccaggccgaagttgaagatattttaagcaacaaggaaaaactacttagttttaaagacgaagacggtaactggttaacccggcgtttcctcttttctaagtggaccttacgtgaaggttgggataatccaaatgtttttacgattgctaaattacgaacttcgggttctgagattagtaagattcaggaagttggccgtggcttgcggctgccggtagatgaaacggggcatcgcttaaatcaggatgaatggcagagccgactgtccttcttgattggttatgatgaacgggatttcgctcagaaattggtgggtgaaatcaatgaagattccccagtgaagttgaacaaagaagagttgactgatgacatgatcaagttaatcgttaaagctaaacagaaaacagatcctaagtttgatgaggatcagctgcttgatgatttagatagacataatgtgattagtcgttctaataagtttaaacaagatgttaatctcgatggtgaggccatgactggctatgatgcattatgccgcctctacccagaattagaacaacaaacgaaaattgctaagggcaaggttcgagataagtattctaaagatagcacaactgttaaattgcggaagaaaaattggttacagttgaagaacctctggttacaacttgctaaacgacaaatggttaagtttgatccctcagttaatcgggatgccgaagctgttgcacgcgatgtctttaatgataatgacaataaaatctttgttttgcaacgtcctcaagtggtgcaccaagaggttgtcactgataaaaacattgcttcagttcaagaaactcagttagattataataatgaatatctaacgatgaattatggtaagtttctcaagggcttagctaagcagactgatttgcctcttaaccttctcaataacctgatgattaagtctatcaggcgcctgcaaaacaacactaactatattaatgaaaagacgttagaaaaccttgttcgcagctttaacaatcagtttaacgaaagaattaagacctcttatagttatgaaccactagactttgcagcatctacatccatttataatgctgagaagaaagagtttgttaactcagtgcctgctagtgtacttggcgtttatcaatctaattcaacttctgatcctacttatttatatgatcgcccaccgcttcgttatgatagtgccgatccagaattaaagattttgcaacgctcatatggtccgaagatcagtgtgttcggtaaattacccaagaaggccatcaagatccctcgctttgacagtggaacgacgacacctgactttatctttaagattgagcatggtgctaaaccaatctatctggtaattgaaacaaaagctgaaaatatgcgcttgggtgatgaagagatccgtattatccaaaaaaagtactttgatcaccttaaagagtcaggtgtttactatcgaatggctacgagtgaacaggaggttcatgacttaatcaataaattgacaaacggggagttggactaggatactgtcgctaattgtattagtcatagaagagaaattagaaaaaatcggtgtttaacctaaactccaaactgagtgaagccagccactggatgtcaccactgccgcacttatccttttttctcacgaatgttgccaccatacagtaaggtagagacgagtaatgaatttaccctagatgtcgacacttaatttgatattcagtgaacaatatcgatactgtggcatttgtttgctagtttttgcgtatatcgcatatattgaagaacaggtaacccaccgaaacttttatccggtagaagcttgggaaaagaatgcgttctttctggatattgtttagtttgttcaacagacaagtcccctatgtggtgtctttttatttactttgattaaactttcttaaccttggattgcaagtaactagtattcgaggaatgttgtgattaattcagaagaagtacctaaatagtggatggtgaaaaactataaaagtactttaataataggatttaccaatagttcggcgtataataagtgcaacccttatttgcccgaaatgcctatgctttgggatttacccttgcacttatcgctgacctatcggaggaattgatcatggtttatcgtcaaaaagcaacgcaactgtcacttgaatcctttggaagcgctctgggaacaccgctcagcccggacaacgagtgggttcaatatgcagaattgatcccatgggccaaacttgaagaggcataccaattacagtttccttcaaaaaccggccgagcagcgaagccatttcgattgctttatggcgcaacgttgatcaagttgaagaaaggcctgaccgaccgccaagttgtcgacgatatccgtgatacaccagcctatcagtacttcatcgggttacccgaatatcgcgctaagaagccatttgaacacacaacgttggtgcactttcgccaacggctttcagccatctcagatttgatccgcaacattactaatgacttcacgcgcgagcggttggaggccgatctacctgaggggacgcatgttttgattagtgatgcgactgccgttccggtcaagatcaagtatccccaagatacaacgctgcttaaccagagtcgtttgaatctcgaacaaatggtcacagatctggcccacgggttaggtgtggaaattccgcggacatacagacgtgaagcaaaaggtaagtggaccgctttttcgaggaaaccgcggcgtcaaaacaaggaacgccgcaaacagcttcaagctcagctacaatacatccgaagagatctgcgatatgtggcggaactgcttgcgcaaggcggtcagctcactgattggcaagcacagcgtctggaagtgattaaacaagtctatgagcagcagctcttcatgtttgagaaccacactcaccatgtcgagaatcgcatcgttagccttcaacagccgtatatccggccaatcgtgcgaggtaaggcaaagcagtccgttgagtttggcgccaagattgactgttccatgttggatggcgtgattgatgtagagcgtttcgacttcaattcatttaacgaaagcactgatcttgaagtaacgcttgaccatgcttttgacctagtgggtgaatatccggatgaggtgctggtcgatactctctatcgcacgcgagataacatcaatctgtgtaagaagctaggcattaaacttaatgggccaaagctgggtcgaaagcccaaacatgtggatccgaaacagcgcaaagccgatgtcagtgcggaaaatcgtcggggtgccattgagcgcaagtttgccttcttgaaaggttcacttgggcttgacttagtgaacaccagaacggctgagtccttggtggtaacggtggatagcgcgattgcattggcaaatatcgacctcctccttaagcttttttctgtaccaatttctattgtggtcgaacagggtggcctgcattatcaaatcaactataaagtgactgaaattcggccagaaaccgcagcctaaatcaccaggcactaaatacggcgatagtgaactgccacaacccaaaatctctaatatactttatgtacgcgcttaccatagaagtgttcaaagtatattgggggtttttgctataacattgttggcactcgattaacctcgatgttcgagtctgacaatagctacggcactagtggacaaagctgccttcggatactggttttacccgcggttttgctgcggcttgacggcagaatcatgataaccgcctaaatatttgctcattcaagttgctatgtttggctggtttcgattatgatcagtatcagtgacacgaaatgggggagaatggtgcagcacaagactttggcaatgaagtggttgtttttgggatcactaatcaccaataccggcattagtttgatttggccgttaacaacgatatatatgcatgaatatttgggtgaatcactcacagtggcgggaatcgtcctttttttgaattcaatgtttatggttattggcaacagtctcgggggcgggttatttgaccactggcagccgtatgggacggcgctggcaggcatttgtctgaatcttggtgcaaccggtttgttgatctttttccatggctggccggcgtatccgttactactggttatttccggttttggcagtgggatcacatccacggcgattaattcttatgcgacgcggattcgcgacaaacgcccgagtgtggtgtttaatatcttgtatttcacatcaaatctaggacttgtgattggcacgctgattgtcgggtttgtcttgccttatgggattgccatggtgtttgcattggccgcgctgctatttgcggtctttttagtggtcgcgatctggcattatcgtattgaaaaagaaactccgacagccgccgaacagccagtcgcccgcggcagtcgcaatccggcgcgcccacggttgatcatgctgatagtgacgttgtttgtgacgtggttaatgtatgaacagtggcaaagcaatatttccgcctttatgttaagcgaaggcctcacagtcaaggactacagctttttgtggacagttaatgcactgctgattgttttgttccagccggttttgacagcgtttgatcactggttgttgcagcatatccggttgcggttgattggtggttttgtcttatttgccggttcttttttgattttgctaaatggttccgggcaatatctgacatttattatcgccatggtggttttgactttaggcgaaattctggcattgccggcagtttcaacttatgtcactttgtttacgccgcttgcacaacaagggcattatcaaggtttgattcaaggctttgcgtcagcgggccgagcactggggccattgttaggtgcaatggtgattgaaggtacgcaaagttatcggctgttgtttgtcggtgccaccggtttgattttattagcggtgttgggctttgcctttacggttcgcgaaagtattccggcactgaatgatccgttacacccagcggctcattaaccgccaaatgatgcaaattcagttttaggtttcatgcaataggcacgtgcaaaggcacagggaaggggaatttttcttgcactatcggttgattctgagtgatattgatggcacactgcttaattcaaaacacgagctgactgtcggcgttaaacaagcgattcagcattatgttgctgcgggcgggacttttgtacttgcttcggcgcggccgcctttagccatgaccgcgcttgcgcaacaaatggggttggcggtgccgcttgtcagtcttaatggtgcggtcattgctcagccaaccgatgataagaagctaaaagtgttggcaacgacgccttggccagcaggaattgcagccaaagtttataccgcattatctagcttaacgctgagcttgaatgtgttcagtgacacgcattggtatgtcgctgatacgagtcagtggacccggcaagaagcagcgatcaccggttttgcaccggaaacagttccgattgaaacagggttagcaaacggtctgccagtgcacaaacttttatgtatgggcgagcctgacatgatcgatcgcactgaacaaatcgttttagcccatccggaatggcagttggttgccagtcggtcgaaggcaacttatctggaaattgtccggcaaggagtgtcgaaagaggcggcgttaaaaacgctcagtcatttattcgacattccaatggcggcaacgatggcactcggcgatggtgaaaatgacctgccaatgttgcaagcagccggcctaggggtgaccttggaaaatgctttgcctcaggtgttagatgtcattaaaacagttgtacctgataatgatcatgatggggcagcagtcgccatcaagcagtatgcaatgggtgaaggttaataaaaaagcgagtcgaattcttggtgatggaagtcgactcgctttttattttaaccaaaatagttttatttaaacctaatcttttaagtcagtaatcgcctgttccaactcctgcttctgagctgtagagatttccggatattttagcggcaaagcggtgacttcgcggttgatgatttgggacacaaccagtcgggaataccacttatcgtctgacggaatgacgtaccaaggatttgttttggtggcggtgtgttgaatggcctcttgataagcttgctggtaatcatcccaaaagcggcgttcgtgaatatccgccaatgagaacttccaattcttttcgggaatttcgattcgttttaagaagcgatttttttgttcgtccttggaaatgtgtaagaagaacttgagcagcaagatgccattgcggtgcgcataggtttccagcgccttgatatcgttgaaacgtttggcccataaatcatcatggacatcagcaacggtgtcaattcctggtaggttttcttttaatagcaactcgggatgaactcggtcgaccagcacttcttcataatgggagcgattgaacaccgtcagttcgccaccagccgggaacgcgttgtggatgcgccataaaaagtcatggcttagttcaagctcagtcggtaccttaaacgacaccactgaggttccctgcggattgacgccggacatgacgtgttcaatcatgctgtctttgccggctgcatccatcccttgaaaaataatcaagacgctgtattgtttctgcgccgccaagtgttgctgaactttagagagcaccttgatgttatgatcaatgtctgctttgatctgctcttttttattttgaaaatgttctggcggtgcggtcgcaaatgcttgaatgttaaaggtgccagcaccgtcaaaacgatatttttccaatgtcatcttatcaccctcgatttatgcttagtttcaacatagtagttacgcctaggatgtgcaagcaattgacgccttggcggattaaatctatgctgagattacgacatgaaaacggaggcaattgcatgacattaccaagaattcaagatgatttgtacctggccgtcaatggcgaatggcaagccaagacgccgattccacctgacaaaagtgttgtgagtgcggatagtaatctgaccgatgatattcgccaaaaactagtggctgacttaagcacgatgacgaaaacagccaaaactttgccgctccagtatgcagcgcggttgtttgccaaagccaatgaccaaacccgccgtcagcagctaggcattgagccagttcgtgaccggataagctttttgatgacgctcacgacgcttgatcaatttcgcagtgctatgcccaaactggttgctgaccaatacgtcttaccgatcagtccctacgttgatgctgatatgcacgatgctgagcataatatcctgaatcttggcgggccagacacgattttacctgatgcggcgatgtaccaacatgaagatgccgaaaatgcggcggatctggcagcgtggtcgcagatggcagctgccatgctggctgcggtgggattcagtcagactgatcaaacagtatatgttgaagcggctaaacgatttgatcggcgtttggctgattatgtgccagcaaatgttgacttagcggtagatagcacgtatgacaatccattgagctggcaggcgtttgaagatgcggccggttatttggggattccacaagcctttgcaacctacatgccgcaaacaccggcgaaagtcaatgcggttgtaccggcttatcttccgcacttaagcaaactattgacgccggacaattattcagaatggcacgcatggatggtgattaacgaattgctaacctgcgccacttacctcagtgatgatttacgtcaattggccggacagtatgatcggtttttggcgggtcaacctgaggcgttatcgtggacgaaacacgcttttgggattgccaacgagtattttgacgatgtgattggtcagtattatggtcaaacctactttggtgccgatgctaaggcagatgtgacggccatggttaagcagattcttgcgcaataccgcgtacagctagaaaacaacacttggctgagtccggctacgaagcaaaaggcgatgcgcaagttagccacgatgcaagtcaaaatggggtatccggagcgactcttttccttgtatgatcacttgagcgtggatgctgacgatgatttgttaacggcaattctgaaacttagcgcacagacgcaggccttttggtttaaacaggtaggccagccggtggatcggaatcaatggaatatgccgggacacttggtgaatgccagttatgatccgctgaaaaatgacatcacttttcccgctggtatcttgcagccgccgtattactcactcaaatggacccgggcggaaaacctcggagggacaggcgcaacgatcggtcatgaaatctcgcattcgtttgataataacggggcgctgtatgatgaatatggtaatttgcataactggtggacgccagcggataagcaggcatttgatcaactggtaaaagcgatgtcggcacagtttgatggccgtgactatgaaggggtcaaggtcaacggcaccctgaccgttagtgaaaacatggcagataacgccggcatggatgtggcgttggcattactaggcgatcagccggatgttaaggacttacaggcattcttcatcacttacgctcgttcatgggccaccaaaatgcgaccggagcgggctaaaactgttttgcggcaagatgttcatgcgccggctaccttacgcgtgaatgtgccggtgcaaaactttcctgcatggtaccaagcgtttaatgttcagccacaagatggcatgtatcggcaaccacagcagcggctgacgatttggaatcggtgatatttaaataaaagagttttatgtgaacctttttcgagaaccgcgagatcaactgtatgtcacactgttcatggggaagcgtaagcaaaaaggcaacgattgccatgtcagacaatcgttgccttttttcaatcttgggacaggtcgtggtaataatgcagccagccggtttcacgttcaccgatctgatcatacaaatgttgagcgccaagattgctagtacgagtctgccaacttgcgccgctgtatccgtgcgcttttgccaggtcgaacgctgcgatcatgagttgacgcgccaacccgtgccgacgaaactttggtgccacgtagacgtcattgataataagcagtggtttcagcgctcgggtttcaaagctgcggtataaaatcgcaaatccggctaattcttgatcaacggtggcgaccaataagtgaccaagactggtatcggagcacaggcggtcaaggtgaacagccattgcctgtgagtcaatggtcagcggcactgggctatcatgatagtaaccttgaacaagcggtaataagagtgggatatcggttgtcactgcagggcggactgccataataaaatcctccttgattgaagtgagcgtgaaccggcgcgcttagaagtcggagtgtaagtggcctcagtcgtgatggccgggctttggccattgcgactgaggtccttatacgcagacttctgcgccagtgaacgcgttatggagcgtgagttgacgcggctagggatcggagtgtaagtggcccaggtttgaccattgcgatcaagacccttacatgcagattcttgcgtcaaacaacgcgttatgaaacacgtgatgaagccttaacgattgtgaaaataagcactgcacacaagttcatctgcaactattttacctgcaacaacagcaaaaagctgctaatgaagtctgagcttaaaatttcttgaaagtctaatttatttccgctccgaagtcgccattgaaaagaccgccacacagccaaagcctgtgtgactggcaatggttggaccgatgttaccaatctgcagcggcgtttgcggggaggcgtcatgcaggcgctctttgacaaagtttgctgcctcaaaatcgccggatgttgatatgataatgcgatgttgcggattttcctgaatggcttttaaagtctcgttggctaagtcaatcagcgagcgtttgcgggcgcgaaccttgcgcacaacgcgtaatttaccggccgtatcaacgtccatcaccggtttgatgtttaacatcgttcccaatgccgcggaagtacgcgacacgcggccaccgtggtacagaaagtccaatttatcgaccgtaaaccacatccggtagtccagtcggtgcgctgtgagccagtgcgccagttcatcgattggcatgccagcatcgcgtttttcaatggcatccagtaccaattgtccttcaccagcacacgcagctagggtatcaaccaagtaaatctgcgcatctggatacttttccagtaacatggcacgcgcttgagtcgccgaattgaaagtgccgcttaaaccgctggaaaagccaacatataagatgggcgtgtttgctttgacatacggtgtgaaaaagtcaacgaactggccgacatttacctgtgtcgttgtgggcatcacattttgcttcagttgctcgtaaaatgcattgatatcgtaatggtcttctccaagatcgtcttcataatctgtgccgttgacggtgaagtgcatggagacaaattcaacttgatgatcatgcaaagtctggtagggtaagtcgcaacaagaatcggttaacagttgatacatggtttcacctcaaaatatccgcactaaaacggatctgttttcatcaatactacgctgtttggggttgttctgaaagctaagggcggatggcgtaccataaagtcgttgaacgataccagccctacctgatgtgatgcgcagtagcggaacttaaaaagtcgaattgcattgtgccattcgactttttaaccttacttttccttggtggatgctgacggttgtttttgattgaacagggttcccacagcaggaagactgcctaatgaatcaatcgcggtacttggtagaaccactgtgttggcagtgcctttagctaaagcttcgagtgcctcaacatttttatatttcaaatataaatcgccattgtcaatcaagccggcattgatcgagttaatttgatccttaaccgccgctgcaatcagccgttgactttctgcgtggccttgtgcttgaaggatttgcgtttgcttattggcctcggcttcaagaatcgcggcctgcttttcaccttcagctttagcgatcgctgcttgcttatgaccttcagcttccatgatgttggcttccttttcccgtgaagcgcgcaacagtttgttcatggagtcttgaatggtagcatcgacttgaatggaatcaatgttgacccgatcaacattcaagccgtagccagcggtggtttcggcgatttgctgaaacaaggtttggttaatggtttcggtgccgttcaagacgtcattcaaatccatattgccgataatcccacgcagattagcccgcgtatcttgaaccatggacaacacggaatccttgttttgataaacataggcgttaacatcagtgatatgatatttcaacgtttcggaaatacggacgacaacgttatcttttgtaatcacttcctgttcattgaccttcagcggaatctgcttcatgttgacgatttcggtgatccgatagatgaatggtggcaccacatgaaaacctggctccaacgttgctacatatttccccaaccgttcgacaatgccaacttcaccggtatggataatggcaacgctggtgaaaagaattgcgatgacgatgactaaaacaatgactagaacagaaatcaggataatattcatgcgaaagccccccgtgtgagcgagtcaattacgactcaatctcaataatgtaagcgatgttctggtttgacgacgctaagataaagcggcgagaccgcattgacaacgacagtatcgccagccgcagcgtcatcagtgacccggtaatgataatgaatgccataaagcgtaatctcaccctcttgatacgatgttggtaagacaaacgttgtccctaaaaggcgatcgtcaagcatgggcgctactcctttctggtcatcttcattgattgctttgttacttgacgctagcaatgattatcacaagccaattttaaagcagggttgaatgaaagacaattgggacggcttagaaagaaaaaattatgctcgttattctatgctggaactttagtacagtctatgcttcattccgtaattagttcaaacactttttattgtggaagactttgttacaataagaccattgtggcacgaatggttggaacggttaatgtaggtgtgtgtcgttgcctgcgctggctcacgctccataacgcgttccccagcgcagggatcggagtgtaaggacctttgccgcaatggccaaagcccggccatcacgtctaaggccgcttacactccgatccctaaccgcgctggctcacgctcactttattttagaaaggatgttgttgatgcgtagacgacgagttatttatgcaaatacttatcggcatcggcggcggctgtggtttttgctgattagcgcaggagtggtcacggccttagtaatcggctggtggctgctgcgtaatccacggccggatccgaccgcttatccagtgttgggcgttcgccttgatcaaaccgatggcgttcaggattttgatcgtttacgtagcagccgggttagctttgtttatttgaaggccacagaaggcagtagctattttgacgataattttaataccaactttactcaggcagcagggagccgaatgagcataggcgtgtatcacgtttttagctttgaaacgacaccggaagctcaagcagctcaatttatccgcaaagtaggctccaacattggcgatctgccaattggtatttacctaagttattatcgcgagcaaaagccgagttccgcgtggttgacacagcatctaaccgagtttatcacgctcgttcaacaacgctatcatcgccaagtgttgctgatgggtagtcctgatattttaaaggtggtcaaaacagtggttccacaagcaccgcggtggacgatcacggacaagcggcctgctgacaatggcggcttttggcaatatactgacggtgcgcggttgccagacggtcctcaggcatcctatcgagcagcggtattcatgggcaagcgcagcacatttttgaagctggctcaatagtcggaccaccattaattcgtgcaaaaagccgagcattgcactgatctaacaaaaatgttcgttgaatgttcgccgaaactatctacttaattgaacgattgggacatactgataagcgaggtgaacagataatgaaaaaagtcctgatcggcttggttgtgctgattgtgctcgtttttggcggtttgaaaatttttgaaattaccaactatggcggaaccacgtactacacaaaaattaccaacactggtcagcgggtgacggatcgcgatgatgaaggcaacaagtacatcatttatgcctatgatttgcctggatatgatgagaaaggcggtctgcagcagttgaagtttaatgcgaaccaagatcgaccgctgagaaaaaatgcttatctaaaagtaacgtacaatgataaaaaaggggtcaccagctgggaaagtgtgccgcgttcggaagttcccaaagcggccttgtcaaaacttgaataaagcaatcaaacgcatcactttctataacgcgctccccggcgcaggagtctgcgtgtaaggaccttggtcgcaatgaccaaagaccggccatcacgtctgaggccacttacactccgattcctaaccgcgccggggagcgctcaccataacgcgttcgctggcgaagggatctgcgtgtaaggaccttggtcgcaatggccaagcccaggccatcacgcccaaggccgcttacactccgatccctaaccgcgccagctcacgctcacatcaaaaaaagtgcgatccgattttgctggatcgcactttttgcatcttatgcgctgggaatgataatggcgtaggtagcatcttctgcttcgtcataaatggtttgcggaccattatcatccgctttaatgactaatttgtacccataatgatcgagaaaagtcagctcgttgatggtgatgccgacaacttgcccaggtagcgttttattgtcgatcttaatctgcagttggggcgaaatcgctagcgagtgggtcttattggtttgctcatcaagaaaagcaaaactccctgtgaaattctttgccaacgccaatgcgggattaggcgccttgtcctgtgccttctgatgatgaccgtggtgcgcgagtaaatgtttcagcccgcgtaaaaaactcgccatgtttttcgacctcccatttctgtttaagcatagtctaccatgagtttttagtttagtggttacagtggtgctgtttttctgttactgggctgttacaataatcatgagcagttttgccagcttgatgttaaatcacggcagagctggatatcatacgtacagccgtgagtgactgttataatgcttgataacgcgtttactggcgcaggaacttgcgtgtaaggagctaagttgcaagggtcaagttgggccatcacgcctgaggacaccccttacaccccgatattctggcgcgccagcttacgtttagaggaggattttaccatgttgaaacttggtgtgattggaacaggatggattactaagcagtttgtggatgcagcggcggccacgaaggcatatacgcttactgccgtttattcacgtcatcaggagagtgctcagacgttcattgatcaaactgcaccagcaacagcgtataccaagatggacgattttctcggcagtgatgtcgatgtggtgtatattgccagtcctaacagtttgcatgcgtctcaagccttggcagctcttgatgccggcaagcatgtgattgttgaaaagcccttggttgcaaccgctatggaatttgaaaaactagacgaggcattacgcaaaaagccttctttgtatctctttgaagcagctcggcatgtttatgagcacaattttcaggttgtcgatcaatttacccatcatcatccgattgacggggctaccctgacttatatgaagtattcttctaagtacgatgcttttttggctggcaagttgccgaatgtttttaatcccgagtttgccggtggtgcattgatggatctgggtatttatttggtctacgatgccgtggcttggtttggggttcccgataacgctgtttaccttccacattttctcaagagtggtgtggatggcgatggggttgcgcgcttggattatgatcaattcgcagtaacgttgattacgggtaaaacaaccaatagtttcttgccatccgagatttattccggtaagcaaacgttgaccatggacaatgctgctgaacttgaaactatcaagctcgatgatcaagtgcttagtaccgagaaattggcgaacccgatggaagcagaagcagcttattttgccaaagctatcaccggtcatgatcgcaatgcgtttgataaggcatggcagctggccaaggaagttcatcaagtcatgtcaattctgcggacgtccgcaaaccttgatttttagtgagcgtgaaccggcgcggtttctaggctggcgaacgcgttatggaggacaaatattgtgacaattgcaaccccgtttcaaaaacgttggcaggctgccgggtatacggagcagacacccattcaagcagcggtttatcagccgttgaaaaccgatgaggatgtcatcggtctggctccaaccggctcagggaaaaccttggcatttggcctaccgttactggaaaaaatcgtgcccggcgatggtttgcaaatactgattttggcgccatcgcaggagttagcgattcaaacgcgggatgttctaacgccgtatgcacacgatatcaatgtggcggtgcagggcatcatcgggtcggctaatgtgaaacggcaattgacgaagctaaaagaaaaacctgaagtcattgtcgcaacagcgggccgtttgcttgaactgattcaatcgcacaagctgaagttggatggcttgcaaacgctggttgttgatgaagccgatgagatgttacgggatccgggattcgatcaggttcgcgaaattgcggctgcggctccggccgatgcccaacttgctttcttttcagcgacaccgagtccgtattttagcgagatgcataaatggtttggcaagacgcctaagctggttgatgttcgtgcgattgatcaaacacgcgggacggttcggcatttattcttgcaaacggatcgggcacatcaaattgattggttgcgaacgttggcgcacactgatggcttcaaggcactggtgttttttaatcaaaatgcatcgttggaacgcgcggccggtattttgcgccaccaagccgttcgttttgccgtattgtcgcgggaaggccgacagactagccgccaaaaagcgttgacggattttcgtaacggccggattaccttattacttgtgaccgacatggctggccgtggattggatattcctaagcttcctgccgtggttaatttcgaaccgcctaagcgtgctgaagcctacattcatcgcgcaggtcgtaccggccggatgggtgaacccggactagtggtaacgttaggagacgaccacgatcgccgggacttgaaaaaactggtaccgcaatatgccattcagcgtgcctatatgagcgatggaaagctggtgaccacactgccagcccgaaagccagataacgaaacgccggtgacggtcaaattaccagcaccgagtcagcgtaaaagtcggcaggttgcggctaaagatcggccggttgcgacaaatgaacccgaacaaaaaccgcggcgtaagcataaaaaaaagcggttacgtgatcagcgcaataaaggcaagcacaaaaacaacacatgaggctgcatcagcggtatgataaggatggagggcagtcatggcgagtatgaaggcggaacaaatggctgcaatgatgacactgatgagtgcagccggtgatgcggaacaggcaacaatggcagcgattgaagcagccaaagccgatcagatcgaccgcagccgcaaattgttaaagcacgcggatgccaagttgaaacaggcacatcaagcccagacccaaatgcttacgtatgaggcacgagggcaaaaagttgacgtaacgttattaatggtgcacagtcaggatcatctaatcagtgccatgacgattcgccggcttgcggatgatattattgatctttaccagcaagtgcacgcacagaagtaggtcaagggtttgttggtagaggttggttgtctggcgagtgcgttggggcacgggctcacgatcaccataacgcgttcaccggcgcagggatctgcgtgtaaggaccttggtcgcaatggccaaacccaggccatcacgcccaaggccacttatgctccggtttctaaccgggctggctcacgctcaccataacgcgttcaccggcgcagaagtctgcgtgtaaggacctcagccgcaatggccaaagtgtggccatcacgtctgaggccacttacactccgacttctaagcgcgccggtgaacgctcactttataaaagaggtaatccccatgaaaatcgagaaaacattacagacaccggcagcatttttatatagtaaaatcgttgcaccggttcaggccgatattgcggcggcgagtcatcgtaaggttgaagttgatgaacttgctggttatacctatcgcaaacaatttcctgatggtgaatgggcaaaggtcaagattacgcaaaatgtcatcaatcgtgaatttgcgatgctgacgatgacccgtttttctcgctttaaggttcgttatttgatcacgccgcttagtgctgatgcaagtcgtgtgcaggtaagtgaaaccgtgcagccggttaattgggcggcgcagcttaaacagatgatcaccgagctatttgtcggccataagcggcggcgtaatgttggccggatgttggactcgattgagcgttcttatatgacggcttaatgaggctaaaaggaacgatatcgttgagctgcagctgctgagacaacaaatctatttgaattgcgctgctgcttttggcataattgactttgtctggtgcccttagctcagcaggatagagcgactgcctcctaagcagtaggtcatcggttcgattccgatagggcacagtcataaaaagcacagtcatttggctgtgctttttattaaattgaaataggcatctttcaatagcaaacaaggaggggccttacatgcaggcgtttatggccgtctatgttccaggttggctgatttttattggcgggatcgtgttgatcagtacggtcaacggggcgacagttcaagccttggttaatcgcgttggtcggtctaatacgcagatctggtatatgaagccgggaatttttgtccatgaattacttcacgcaattgttgcgcggctatttggtttgcaggtgacgaatttttcgttgcgggctgatccgcgacaaggcagtgccgctcatgttagtttgcaatatcaacggcataatccgattgcccagctaggactgtttctttctagcagcgctccggtttggggaattagcctcattttgctggtactagggcggtgggcttttttctcggcaggtagtcaagtgtggcaggtgtttgcgaccacggccagtctcggtgaaaaatgggttatgatgcgcgacatgatgcagattaattggcgttggctgctgatttttttcgtgttaaccttagttttaacgccaggggttgctttgtcgcatcgggatttgcaaaatatgtggcagagtgcgccgattgcttttctggtaacaattgtgatcttttatagtttgctgacgttttggccagcaggatttgcttggtgggcgtgggtaaatttgaatttgttactgttgaatttagtgatgctgagttttagtctgctcatctggttactggtcagtatgttttagttgctgtgatgaagtagcagttggcgttatgctaatcagaaatttttaaaagggaaattcaattgcgatggcataatctatgattgagtcagtcaagtttttataggaggaaaaagatgcttttgccgcagccagcgacgattttaaaagaaaaatttgggtacgatcactttcgagccggtcaaaagcaggcaattgagcgaattatgaccggcaagagcacgctggtcgtgatgcctaccggtggcggcaagtctttgtgttatcaggtgccggcgatgattctgccaggcttgacgctggtcgtttcgcctttaatcgctttaatgaaagatcaagttgatgcgttaaacgacaatgccattccggcggcgtttattaatagcacgttggattatcgtgaaattactgcacgtctggaacaggcgcgcagtgggaacattaagttgttatatgtggcgccggaacggtttgatgcggattggttccttcaacagctcggtgacatgaatatctcgctttttgctattgatgaagcacactgtatttcacagtggggacatgattttcggccgagttacctcaacttggctaatgttgcggctcaattaccctcgcagccgccggtcattgccttaactgcgacggcgacaccgcgggttgctcaagatatttgccaacgcttgatgatcccggacgatggggtcatcaacacagggtttgaacgtgacaacctgagtttcaaagtggtgcgcgatcaggatgaggatcggtacttgttggattatcttaaactcaatgttgaccaatctggcattatttatgcaagtacgcgcaaagaagtcgatcggatttatgcgtttttgcagcataagcagttgccggtagccaaatatcacgccggcatgactgaaaagcaacgtgctgctaatcaggaagactttttgtttgatcgtaagccgattatggtcgctaccaacgcgtttgggatggggattgataaaagtaacgttcgcttcgtgattcatgctcagattccgaaagatttggaatcgtattatcaagaagcaggtcgcgccggtcgtgatgggttgcctagtgaggcgatcttgttatttagaccgcaagacttgcaggtgcaacggttttttattgaacagtctgaaggtgacgaggcgcatcaacggcggcagtatgacaaacttaaagttatggaacgctatgccaacaccgatcagtgtctgcagcagtttattttgaactattttggtcagactggcactgccccgtgtggacgttgttcgaactgcttagatgatcgtgaatccgttgatgtgaccattgacgcgcagaaggttttgtcgtgcgttgtccgattgcatgagcggtttggtaaaggcattgttgcccaggtcttggctggcgcccacaatcagcgcgttttgtcgtttcacctcgatcagttgtcaacatatgggctgatgaaaaatcggcgacagcgggatattacgaccttcattgatttcctgacggccggtggctttctggaaacgcgtggtggtcagtatccaacgcttggcttaaccgcaaaaggcgctgaagtgttacgcgggcagataaccgttttccaaaagaccgcgcaaaaagttactcagacgcttgaagtggatgacacggtcttccaagaactgcgtagtactcgccggcaattggcggagcagcagcatttaccgccgtatatgattttttccgataagacgttaaaagcgattggcaatgcgatgccgaaaacgttggatgagttgctggcggttaaaggggttggccaggcgaaacttgataagtatgggcagattttcttggacgtattgaaggcgattcaaacggagaaagcgtgattagggctcacgcttgcgataacgcgctccccggcgcagaagtctgcgtgtaaggaccttaagcgcaatggccaagagcgggccatcacgcttaaggccacttacactccgatccctaaccgcgccagctcacgctcaccataacgcgttcgccagcccagaaacctgcgtgtaaggacctcagccgcaatggccaaaacccggccatcacgtctgaggccgcttacactccggtttctaaccgggctggctcacgctcacacaaataataacgcatagaaaaaccgagccgttgatttttgcagaatgagtgcaaaaaagtcgcggctcggttttttactaaaataacggtagcgatgagaagttaggcccagtcgccgttgcggaaaattgggatgatggttccgtctggtttgatgccgtcaatgttcatcgcggcggagcccatcatgaagtcaacgtgggtcggactttggtttaatcccaccgccgcgcgttgttcgttggtcatggcaaccccgtctttgactgagaacggataggcttgaccgagtgccatatgatcggaagcattttcgtcaaacagcgtgttgaagaaaataagtcctgattgtgagatgggggaaggatccggaaccaacgacacttcgcctaatgaacgagcacccggcgttttcagcaggttttgtaagacgtcatcaccttgtttggcgtgggcttccacaatttgcccgtctttgaaagtaaagtgcatatcttcgaggatgttgccgccataactaagcggcttggtggaaacaacggtcccgtcgatgcgccgaaaatcaggggcagtgaagacttcctcggttggcatgttagccataaattcctcaccacgcgggttaaaagcgccggcgccttcccaaatgtggttctttggtaaaccgactaccaaatccgttcccggagccatgtaatgcagctgatcaaattgttcgttgtttaaccaagccgctttttcccgcagcttttgatcgtgggctttccaggcagcttccggatcgggttgatcgattcgggtagttttgaaaattgcctcccagagtagctcagttgcttcttcaggggtggcggcatcagggaaaactttttgagcccagcgcggacttgcagcaccgataatcgtccagctaatgctcatggaactgattgcttccatgagtcgtttgtaggcttttgcgaacgcttcttgatacttggcaatgcggttggaatcaattcctgccaagttatccggatctgatgaaaccacggtaatccgcttggcttggtgatcaacccaataatcgaattgacctttgacaaacgccgggatgttgaaaaggcgctcgtctgccatgtgcgccatatctaaacgcttgagtacatcatcgaaccactgaacctgaacttccgcggcaccgcgttggtaagcagccgcaacgatcaagcgtgccagctgtgcttggtccactgaaatttgcacgtaaacggtatcgccgggtttaacggacaccccaatatcgactgccaattcggcatattttttaaggctttcgttaaagttagataatgtcataaaaacgctcctcctcaaagtgattggcaatagtttaccatagggcggcgaattctcggtgcaaaatgctgctgtgccgtggcagaaatcttcaaaataaattaagaaaaactgaaatttattagtaaattctgtttccttctgacttcatgtctggtaaaataacaccaagacatgaagttggtcttttggagtggagatttaactttatttgtcagaattaagttgtgtgcaagctagttttaaataacttaaagaaagtaaggggaacaatatggcacgaaaaaaaacgatcacacatgatcagattttaaatgcagcatatgatctcgttgtggaacagggctttaaaagtttcacggcgcgtaatatcgctaagaagatgaactgttcaacgcagccgatttatttggaattcaagaatatggcggaattgaaacaggccgtgatggatcgtattaaagaactgctggctttaaagatggcaaaacactacaccaatgatccagtggttgatttaggtttggcgtatatctattttgctcttgaaaatcggccgctttaccgagcagtatttgttgaagatcactttggcgttgatgaaatgcgtgaatacgctatgagtactgctatgcgcgtgtttgatgcgtatgaaccggctaagaatctaagtgaggcacaattacgcaatacgatttgcggggtatggatcgtagcaaccgggattgccaatctcatggcaccagggttcatcgacattacacgcgatcaaatggttgatatcttaacggcggtcacacaagatttcatcgttaacggccgcttctcagatgacccgcgcatttcttggttcgaaaaagcaaaagtcgcccaaggctattaatagtttaattggggctaaccgttccgcggggggagcggttttttttgttggtgagcgtgagcaggagcgcttagcaatcggagtgtaagcggcctcgggcgtgatggcccgggcttggccatcgcgttcgaggtccttacacgcagattgctgcgactgcgaacgcgttatagaaagcaaaataaaaccccaaaattgcccaaaagagaatacttatgtccctgccgcaattttctcaataaccactgccccaacccctttactcacagctccctcacctcagcccctgatcgccaaatgcacataaaactggaaaactggcggccaatgcgctacttttgatttaataagtaagtgccatgctggtacaaatagctgacatgcaacataacgcgctcgtcaaatggaaggatttgcgttagaaggcgttcgaaagaggttattatgggaagttcatcagatctaaaagatttattacgcgaacgagtcgccactaagtacacaattgacgacctcaaggaaaccggcaaaaagattcggcaagcggttccgattgaaaatctaggggcggtcagcaagattgaccgtgatccagttcagtttattaatagtgttgagcagaatcttatcaaatcgttgctgccgatgcgccatcagcgaatgggtgcatcccaggcagcttttttccgcggcacggccgaattaatggcttatgatttgcggcaaggcgaaaaatcaggcattaatctattaattgacggggatgcccatctgcagaattttggtttttatgcctcgccggaacgcaatttgctgtttgacctcaatgactttgatgaagctcagatcaatagttttgaattcgacatcaagcgcctgctgaccagcgtttatttgcttggcgatcagcaagggtttgacagtgatgatcttgatgatttagtccaaaacgatgccagtatttatcggaaaacattacgggatctattcaagctgggcgcgcttgatcggttctatcaatcgactgaagtagaacgtttagtgcaggtcatccccggagccgaagattcaccgttgttggccaaattcattaaaaaggcgaccaaacgcaacaacgattcggtcattaaaaagtacaccgagacgaatgaagcggggcacatgcgatttaaagatgatccgccgagttcggttcacattgatcaaacaacttatcaggcaatttatgatggctttacccagtatcgcaaaaccacgcgtccggacattttggttttactgagccaatatcgcattactgatattattcatcacagtgtcgggattggcagtttcgggacgaattgttatttgatcctgttgagtggtttaggcggtagtcatttggtgctacaagttaaagaggcgttaccgccacgccgggaattattgcccaatatggaacgcatgaccttgcaacaagaagtcagtcaggggcagcgaattattgcggctcaaatgatcctccaaaaagcgtccgatccgtttctggggtggtttaatgtggacaacaagagctactatgtccgccaatttcgcgacatgaagggctccgttgatcttgatgagcttagttttcccgagttcaagtactatacgcaaattacggcttatcttttggccatggcgcatgcgcaaaccccgcaagcggcagtcgtgaccggttatctggataaacatttcgatagtgcggtgcaatcctggagcaagtggtatctgaatcaggtgaaggccgattattctgcgtttatgcgcgcagtcaagcaacgtgttttagcctaaaagtgcttgattagccggtgtatttatttgccggatttattcgcaaaatttattcataaaaataagtttagcttgttttctgcggattgcttctggcagaattaaagaggatgatcgtctgcgattaacgagcaaggctgggagggaggtaaagtatgggacggaagaagcacccgttgaaacggtcattattgtcggcagagcaagcagccgacattcgctcaggacgtacggctttagcagacatgaagctaccaaagcgcaccaagttttgggtcttcatcaagcttgccattaatcggatttccgactccaacattgggcaaagtgctgctgcattggcttactatacgttgctatcgctttttccgctaatcttatttgttgccaatgctttgccgtaccttggactgaagtatagcagtttggccacttacttaacgcaggcggtgccggcaaatgtcatggaatggctcgatcccatcatcgcaaatttactggattcaagcagcgggggattgctgggaatcggggcaattgcaacgctgtgggcagccagtctaggtgtaaccggcttaaaaatgggctttaatcaagtctacggtgtggaggcaacgcaaaacttcattattcagcgattattatcaatgctcatgacttttaccttaattattgtgatgggcgccattttaattgcctttgcatttggccgccaatttttggaatggctgataccgttgctacgactggataccagctggctgcgaacctttaatacgttacgctggcccatcacggttaccgcattgttcattattattatgtttttggattattttttaccgaatgtcaaaatcaaaatgtggacggtgttacccggaactgccttcaccgttattggctggctcttaattgctcaggcattttcgttatatatgcattattttggcacgcgttatctttcttatggcacgatcggtacgtttattgcgatcatgctgtggttgaatttctccgcgctcgtcttgctttggggcgctgtgattaacgcgttaaccgcagaatacttcatcggccggttgcacagcagcaagggtaaagtgcacgactttttgaaacgccgagtgaagtcagcacattcggaaaaagaaactccgtgaccgccaatataagatgatctaaggcatacgaaaaggctcgcactgaaatcagcgcgagccttttgcctacttactattgcatggcgttgaacttatcaaccaactgttttgtaaaagcttcaagatgcttgatgtcatcttcttcaggagaaagatcaatcttaacattctctgctcctttggtggcgccggttttggcaaaggccttgtcaaaatcatcaaccgaagtggcaaagtcatcatagaagcggtcaccgctaccgcaacaaccatagacttttccagttagatccagctcttgcaattcttcatagaaatcaaccgcttcgtccggcagttcgccatcgccgacatctgagtacgtgtaagttgccgtgacacaaatatcgacatcttcaaaatcactcgcgagtgcttgggaaacttcagtggtcgtcacgtccacattcaggtcttcaaaagcttcttcaatgataccggcaatatcttcattattaccggtcaaactggcatatacaatccgtgcgcttgccatttttcttgtattcctcctaaaacacagcactcgggagcttacaagtcggcgaggctgtcattcttgttcattcgcttgattatagcatacgggaaagccgcttggggagattcactgaagttggctatgtgtggtggggtaggctttggaccgtccccccttcgtctcctgatttacgtggaagtattttgttgacgtcaattctcattatctgtagactgtcattacggttttgaaaagggattcatcatctttttcgttgagcccagtgatttggatggcacacacctctcgacattttgataaaacggaggtgacagccatgccaaaatcaggagacgaaaggggatcgccgcgttggacgtggcaacgattatcgtcgctataagcatactgcttactagcggtgctaaggcatacacgataatcaaaaaagctaaccgaaacggctagctttacccaaaaacgtcatctgatatcacgttgaggtcatcggggctccatcctgatggcctcttttcgacctctaaagtataccttaggcgctggtgaagcgtcaagatattgactggcttgtattcattgaatcgcgttatgtttggagtcttgtaccgtacgctctccctgcttattatgttgatttattttattgacgcagattcatattatctatagactatcattacggctttgaaaaagactgaaaagcttttttcgctgagccgagtgatttggatggcacacacccctcgacattttgataaaacggaggtgggggccatgccagaatcaggagacgaaaggggatcgccgcgttggacgtggcaacgattatcgtcgctataagcatactgcttactagcggtgctaaggcatacgcgataatcaaaaaagctaaccgaaacggctagctttactcaaaacgtcatctgatatcacgttgaggtcatcaggaagcaccctgatggcctcttttcgacttctaaagtataccttaggcgctggtgaggcgtcaagatattgacgggtttgcattcattcaaaaaagctaaccgaaacggctagctttacccaaaacgtcatctgatgtcacgttgaggtcatcggggcttcatcctgatgacctccccctcgacagataaagtatatcttagaaactggtaaatagtcaagggtgttaactgatttgacgatgggattaactcgcatactaacagcattggttgtttagaaaatgcgtcggctcgagctctctttaaacgcgctcgccagcccagaaacttgcgtgtaaggaccttggtcgcaatggtcaaagcccgaccatcacgcccaaggccacttacactccagtttctaaccgggctggctcgcgctctcttctaattaatgctacactaattgcgagttaaattcgtattggaggctggaagtttgatcaccatcaaatcagcacgtgaaataaaaggtatggctaagtcgggagcgattctggcggcgatgcatgttggcttgcgcgatattattaagccgggtatctcgagttgggagattgaaaagtttgctaaggagttttttgaatcccatggcgccaaggctgagcaggtcggttttgaaggttataagtatgttacttgtgtcagtatcaatgatgaggttgcccatgctgtaccgcgcaagggcttgaagttaaaagacggtgatgtcgtcagtgtggacaccgttatcagttggaatggttattttagtgactcttgctggacatacggggtcgggaaggtttctgaagctgaccagaaattgatggatgtgaccaagaagtcgctttacctgggtattgacgaagcggttgttggtaatcgtattggtgatattggcgctgcgattcagacttataccgaagatgataacggctatggcgatgtgcgtgaactggttggacatggcattcagcctacgatgcatgaaagtcctaacgttccgcattatggcgtgcccggtcacgggttgcgcttgaaagccggcatgacgattaccattgagccaatgattacggaaggtacatggaagattaagggtaaacaagttcccggcgatacatgggaatactatgtaaccgccgatggaagtaagtgcgcacagtatgagcataccctggtgattaccgacaatggtcctaagattctgacctcgcaaggtgatccgattgatgctaaatatcagttaaccgaagacgatctgaagacgcttccggaataacggggatctccgttactatttttatgtgttatgaggtgccggaagcatcaaatcgtcaagcaggaagcaagcagtcattgtttcctgcttttattttattgtcttttttaaaatgttaaccggtttcgtttaacaatggagcaattacgttatactaaaacacgaaggaaaagagggacgatatggcaggtcatgaagcattggtttcggtcatcatgccggtttataatgccgaaaagtatttgactcaggcgctggatagtttgctcgcccaggactatcccaattttgaggtactttgtgtggatgacgggtcaatggacactagcaaggttatcttggcgacttatgcacgtcagaatccacggatacgtgttattcgcgtggaaaacggcggacaggcacgggctcgacaaattggcattcaacacgccaagggctcactgattacctttatggatagtgatgatctggttcatccccagtggctagcaaccatggcagaagggatgcgagccccacgcgtggatatgtctgtggtcaattactataactatatcggcggcaccaagctgaaagcccgttcttttcacgagaaggttaagattgccggtgatgacaagtaccgttattggcttgaggatcgcgacctgcgaggatatttgtggaacaaaatgtttcgcgctgagttatttagccagccggtaccagtggcgaacttcaacctgcttgaggacgcctactttatcggacaactgctgccacgaatagaccagatcaactttattgatgaaccgctttactactatcgcttcaatgcgaccagtagcgtccacgccaagtttcaaaagcgtgatttggaagccattcatcaactgggtgccgttttcttaacgttggctcgggaaaaaccggagttaacttcactggcagttcgtcgttatgctgccttaagcttgttcgttttatcgaaaatgtcgccacggcaactcgtagctaactgggggtatgttcaacagctagggatggtcttggcacaatatgcccgcgagtttcaggggattatctcagcgggggatgcggatgatttggccacagataagtccgataaggcgagtttgttggataaactgcgtgcttggtcgcatctgttaggactgccaacatttgatgacttgaacaagttggcagatagtgaagacgagaatgttaaaaaggagtcttagcgtgtaggggggattcaagggtaggttgggttgtactttcataacgcgctccccgccgcagaagtctgcgtgtaaggacctcagccgcaatggtcaaagtgcggccatcacgtctgaggccacttacactccgatttctaagcgcgccggctcacgctcaccataacgcgctccccgccgcaggaatctgcgtgtaaggaccttggtcgcaatggccaaagcccggccatcacgcccaaggccacttacactccggccctatccgcgccggcttgcgctccgcaaaaaagccatttgccaaaaagttggcaaatggcttcgtatcgagatcaaacatatcgcggcacgttggggtgttggtgcaggcaattaagccggttttttctccgtggtgaagatttcggtgctttgggtttcggtcacctttgcgccaaccggagttgcatacaggccgatgccttctttcttgaacgcttgagcttgtgcaactgcatcggcaaaggcttgtgcttgttcagccgtgatggcaccttcgtacttgctaatccgaatacttgtggatttaccagcttcggatttgaaattaaaaatcagtgttttcattgattatccctccgtttaggctgtgacttctgcgttttgctgcaagacaatgctcgtcaaagcagcgtttggataaagcttggcaaaggcttgcccgatcgcgaccagttgctcgtccttcgcatcggcagcgacattgttcatccggcgcacctgcttaaatgcctcgttctccggatcagttagggtgtacacgatggtttgcttgttaacgttgcgactcatgatgtttcctcctcagttagaatttgtgttgtccgaatgtggcctgcattccagacagttattactggatattttggtccaaaatcccgatcagtgtaggaaatttttgcgtcctacactgatataaatcggtgagttagtgaatatgacaacccttaacttataaatttgtagccattgcagaatatcgaatgtctgctaaaataattaaggtatttctttagaaagagtaaggtttttgctgacttacaattttgttatgtgcagtcagctatacttacagtcggattccttctggggtccttgattaatgaaaatttgaagggttctgattgtgtgataacagcgcaggcgccaggtaaactttatgttgccggtgaatacgcggtggtcgaaactggtttccctgcgatcatcgtggcgttagatcaattcgtcactgtaaccgttgaagcaacgaaacatttcggcagtatcgtgtctgaacagtatcaggaaaattcgttgtattggcaacgtcaaggcgatgaaatggtctttgataaccgggataatccgttccactacattctctcggcaattaaattaacggaacaatatgcgcgtgaacttaacaaaccgttggcgctgtataagttgtatattgattcacaactggatgctaaagacgggaaaaagtatgggttgggtagctcagccgcagtcaccgtggcaacgatcaaagcacttgccaagttctatgacttgaagatgtccaaggatcaaatctataaactggcggccattgcccatcttgatgttcagggtaatggctctttaggtgacattgctgcgtcagtttatggcggttggattgcttatcgttcgtttgacaaagcatggttggcggcagctagaaaccaaatgtcgctatcggcactgatcaatgctgaatggccggagttgtcgattgaactcttaacggcaccggctgatatgcaacttttgattggctggacaggatcgccggcttcaacctctcaattagtcgataaaattacgttagccaaagccaaaaaaccacagctctaccatgatttcttaactgctagtcgtgaaacgctggagaaattgatcgatgggttccgggagcattcgcttagccacattcaagctggcattcggcgcaatcgcgaattgttggatgaattagcgcacttctcgggagtggcgattcagacgccagcattacgacaattggtgacgttagcagagcaagcagacggggctgccaagtcttctggagcaggcggcggcgactgtgggattgttttaattgattctcatcaggcgattcaacccctgctagcagcttggcgtaagcaccacattgaaccactgaaattcaaagtacacgaaatcaacgattaacaacatctcagctatgatttggtaagcagattccggatggataggatccaatggcgaagcaaatacccagtagctgggatttttttatttttatacgaataacttatgaatttttctgggaattatcagaaaaggcgtactcttcgcaagcggtttctagtatagtagagtaggtagttaaattagtagagaagggacttgtatgagtgtgaaagttcgcaaagcagtgataccggcagccgggcttgggacccgttttctgccagcaaccaaagctttagctaaggaaatgttgccgattgtcgacaaaccgaccattcaatttatcgttgaagaagctaaggccagtgggattgaggatattctgattgttgagggtaaacaaaaacgctctattgaagatcattttgactcagcacctgagctggaacagaatctgaaagaaaaacataaagacgccttgctacagctggttcattccacaaccgacatcggcgtcaacttattcttcgtgcggcagccatatccgcgtggtcttggtgatgccgttcgcttagccaaatcgtttgttggcgatgagccattcgtggtcatgttgggtgatgacctgatgaatgacaaagtgccgttgaccaagcaattaatcgatgaatacgataagacccatgcgtccattcttgccgttaaaaaggtgccgcatgatgaagtatcggcatatggcgttattgatccggaaaaagaagtttccaaagacctctataacgttaagaaatttgttgaaaagccagccgttgctgatgccccaagtgacttggcaatcatcggccgctacctgctgaccccggaaatttttgatattcttgataatcaaaaaccaggcaaaggcaatgaaattcagttaaccgatgcgatcgatactttgaaccaaactcagcgcgtctttgcacatgagtttaaaggtgatcgctatgatgttggtaataagttcggatacgtcaagaccaatgttgaatatggtttgacccatccggaagtaaaagatgaactccgcgcgtacatccttgatctggctgctaagttgcagtcaggcaatcctgtggggaagccggcaaataagaaataggcattgtatttttagccataataagagctcgagcagaatcggttatgaggatgctcgggttctttttgtgcgttgagcgctatgccgggtagtacaggatgatattaaagaaatcctttttttaaaatggcaaagcattatcaaccgagcaagtgctttcattttttgcattacttacatataattaactatgtaatataaaaagtattataataatttctgaataaggatcaaagaggcagtcaggactattcgccggtggctggtgaacaaatcacgaataataccgacactttaaactggcaaaatatccaggcggcggcagggacattgtattatcagttagaagttgaatttgatagcggccaaaagtcttattggtacagtaacatcgccccactaaccatcaccgcctccgctccgcagctgcacgcggttcctaatctgcagtttgcgcttagttcgggcgctaacccaagcattgccgatttttatgccgcacagggtgtgaccatggtgtatcagccgagcacaatcgctaaccagacaaactgggatggtaacaatcatggtgcgttggcgattgctggcggcggtagtacctggagtttgaatgttcagttttcaccgtttaaaaatcagacaacgcagcactatttatcaacggagactggtggcagtgcggccgtgaccttgcattttgctgatgggaccgcggctcaggccaaagatgaccgccagccggtgacggtttatagtaaagtgaccaaggatgttactacgacaaccgctaccacgacttcgctgcaggtgccacaaacgtcaacgattcaaccgggaacgtatcagtctaccgccacttggacgctggtcaaggcaccttaatcgtgtgaatctaaaaaacaacccgcacttcgctatcattgcgagaatgtggggttatttttgcgcagcggcaggcttatgcgtcagattctgatagcccgttttgccggatgacttgctgataccaataaaatgattgcttccggtagcggtttaacgtaccgctgccatcatcatgtttgtcaacgtagatatagccgtagcgtttggccatttcgccagtgctggcggagattaaatcaatcggcgcccatgaggtgtagccgattagatccacgccgtcttgaatggcgtcatacatggcagcaatgtgtgcgcgaagatagttgatgcgtgccgtgtcattaacggttttttggccatcttgttcaatcaattcgtcacgcgcaccgaagccattttcgacgaccatcaccggcacttggtagcgatcgtaaatttgattaagcgccgtgcgtaacccgcgaggatcgatttcccagccccagtcactgcgttgaaggtagggatttttgacgccagcaaaaaaattaccgccgctggtttcgccgctttcagtggtggtcatagtgctggattggtaataagacaaagcaaagaagtccacggtgcctcttttaaggagctcttcttcccacggctctatgtcgatggtgatatcgtgatcgcgccaataacgtttggcaaaatagggatagcgacctttcacttggacatcgccgcagtaaaagttattgagttcggtggcagtttggacaagggcaatatcttctgggtgacttgtcagcggatagagcatgcgataagccagcatacaaccaattttcaggtgtggatcgaacccatgggcaaagctgcagactctggcactggccacaaattgatgatgcagtgcttggaggcgcatttgggtggaatcgatatcagggctgatgaatcggttggtgtcgtctacatacataccgccagctaagtaggctcccatcggtcgggttagcatattgatctcattgaaggtcagccagtagtggacatcattgtgaaagttggcaatgacagtttgcgcaaatgtaacatattcttcgatcatgtctcgtgacgcccagccgttgaacgccttcgtcagtacaattggtgattcaaaatgcgagatcgtgacaagtggctcaatgttgtaacgcttgagttcagcaatcaacgccgcgtaaaaggcaagcccttctttgtttgggccgtcgcttgcagaaccgtttgggtaaatccgcgtccaggcgatggagaagcggtagactttaaagcccatttccgcaaacagtgcaatgtcttcttgataacggtgaaaatgatcaatggcttcatgactggggtaaaacgcgtccggacgtacctcgcgcgtgagttgacgggggacattgtgagtgccacccagtaacaagtcgctggtcgacaaccctttgccgtccacgttatacgcgccttcaagttgattggcagcagttgcgccaccccagagaaaattttcgggaaattgacgaatggacataacgacctccttcattaggtttcggggatgaaactgaatagcttatcgcctgggcggacagatgctttttcatgcacttcaatccgttcgggaggcgtattcggtagcaaaacgatcaccgtgggatcaaagccagacttttcaatcagcggcaagtcgattttaatgagcggttggccgactttgacggattcaccttgagagacaagaggtttgaaaaagcgtccatccagtcgcaccgtgtcaatgccgatgtggatcagcacctcttgtcccgaggccgtggttaagccgattgcgtggttcgttggatataacatggagacagtggcatcggccggtgcaacaatggtgccgctttcaggaataatagcgaccccgtgtcccagcgtgccagctgcaaaaacctcatcctggacgcgagcaagcggaatcatctcaccggcgaccacactctgaaaaggttgcggctgggttttagcgctggtgcttgcattggtctcgacggtggcaaagaagtaggtggaaagaaaagtcgcgccaaacgcgatggccacagtcagtaaggcgttgcggaaattagtaggattagcgccgatgaagacgggtagggtgaagatccccggtgaaccgaatgaatagcggaccagcccagtgagcccggcaaaaagaccggccagtcccccggaaaccacgacgcaggttaacgcgtgtttatacttgagcgtgacgccatacagtgccggttccgtgatgccggataacgcagtgacgctggcagagagcgcgatttggcgtccgcgggtttgtttttcgcgcacggcaatggcagcagcggctccggcttgggcaatattgatggctaacatgccgggacccataatcgtttcactaccaaacttggtcatggacaaggtcgctaatggcaagagtgaaacatgcatgccaaccatgacgagcagtggagtgaaggcgccgaccagagttggaacgagccacggcgtatgttgattaatgaaggtgacagcggtataaaggccatcgcctaaaagactgccgatgggaccgatgacaattaaggcaatcggagcggtaatgagtgcgactaacagcggtttgagcatgtttttgatcatgttgggtgcgactttttccgcgaatcgttcgacatagctcataaaccagacgattaaaatgatgggaatgacgcttccaccataggatgctagacgaatgggcgcaccgaataacgcaatgggcttgcccgctgcgaccagcgctgtgaagttagggtgaagtagcacaccggccatcatcattgccagataggtattagtgttgaacttcttggctgcgctgacggcgagcatgaatggcagaaaataaaacgcggcatcagccatgaaactcaaggtgagataggcagtgctttttggatcgaggcccagtaaagctaagatggcgatgacgactttgaacatcccgccggcaatgagaacggtgatgatcggggccatgatactgacgatggcgttaagaatccgtttaattaaattcttttcttgggcttgtgtcgtttgattcggttcgcctgcttcatgaagctgatattgttgttggatagcggcatagtatttggtcacgttagcaccgatgacgacttgagacttatcgccggccaccacggtactaagaacttccggcattttttcgagttgtgcctgattgaattgctgcttatcgcgtaaagtgaagcggaggcgagtggcgcagtgggtgaggcttttgacattttggatcccacctacagcagccatgatttgggtggcgattttggctggatcagacatgttcaagacacccccttaacgccacggtcattttgccgcgttgatgcccgaatcctttattcaactggttgctcgtgcgacagtcatgcttttgtacttgcaatatgaataacccccttcataaataaaccctgttattggcagtaaaaaaacagacatagccaagaagatcgtttgaacgataaaacgatgatcaaagttctgtctgtttacccggtaacagtagatgtgatatcagctgttaagcgtatgataacggatacaaaaataaaaagcaacccgataagattgctttttgcattgtttgtatccaactatttattatttatctaaaaataaatgataaatagcaagttaaattaaattgtacataaaattaaaatgaataccaacatgttcatgcttaataatctcagcggcgaatgtttaatcaaactgttacggctaatgatttttaggctggccgccagtcaccatacgcttgtgaaaacgcgggtgatattcatagaaaatgagggctgcgaggccggtcagccccatgatggtgaccagccacccaagcggtatccccggggtgtggtaagtgagggtaaaggtagtggcttttttagggactttaatcccaatgaagccgcgataattttgaattttcacggactgggtatctgcttgccagcctttttcgtaagggatagtgagcatgatgtagccactgttgttttcttgcgtggttaacgatagacggccgttttggatggtttgcttaggtgcgttggctttggcggttttaaccgtttgcttgaaggcttggcggttaagggtatacagcgcaaagtgatcgaggtcgatttggctgaaaccgcgattgaaggtcaaggtgacggtggtcggtttcgtggcattaagtggcaacgatacggtcttggagccgttgtcgggatcatttttaagggggatgttgttaatgctgatggtcatatccttgcgcatgccttcacccatcacgagatattgctgctcgctgctagggttgacactcaaggtaatgctggccccaagctttttgtttaccttggttgccacggcattggtgagggtggtcagcggtttgacgttatcgacactgatcccggagaaatcagaagtggtgaagatcggggccgtttgctggttcgtcaaagtggcaaaataagcattttgttgcaggaccgggtttgcctgcacttgggttggaattttgctgaaaatctgggtggccacgggtaaggcatccggatttttgtagatgttaaagagctggttgtgaccgactaatttgtaagccggcaaatcatagcgggcattgcaaatattgcgcgaggaagcttgttgatactcggaagtgccgacttttttactcgttgtgttgaggagtaataactgtttgacgccgagtaagctttctagcggccaggtgaggtcattgtttttgacccgcccggctgaaccgattgccccgacattggtgagggtattgatggtgctggtgtttaaaaccgatgaaaaggtgctgatcccgttgaaattatattggtagggatcgtccatggagcgttgggtgtcggcgttaatgcgatagaacccggatggcccgatctttttggcgtcgttgtaagcggcactgagcactttgctggtgacggtgaagtcggctttggagatgaaactgatggcgccaaggctggcataggcattggcgcctaagtcgatgacaagcaaagccaaaagtgcgccaaccgtccattttaccgggaataggcgggtggcataactgtagagcagcacggtggcggttaggagaaggatgccagcgaggatcagatgcggtaaggtgacatatttgtgtgttcccatgcgcaaggcggcggggatgatgagtagcccgccgacgactagactggtgaggagtaaacgtaaccgggacacggatcgcagctgcatgagtccacggagactgagtagtaagaaccagaagatgacaatgaatgagtggcggtataaataccacaccggcgcgcgaaacccttgccagataatggcgagaggattgagccagatggataatatcaagagtaatgtcatgccggccgaaatcaagcgttcacgaaccgggatcgtccgagcaaggaaataaaaactggcacctaataggccgatcatgcccatatacaggttaggcaggccattggagagctgatcaaaattgaaactgcccggaagtagctttgatggcaagtcgatcagcgaatacaaggctttgaaactgaaatcagcaccggcgctggaaaggcgggaagcactcagcgcgtaataggttggaatgagcacgaccgccgcgatcataccgctgagtaacgagccaataacgaataggctgatttttcgcagtaattgcagttgatgttgaatcgcccagcgccagccaaagtaaagcgccgcaaaaatggcgaccatgaagccaatgtaataattggtgatgaatgccagactcagcggaatgacataaggtaacagccgttgctcatcaaataatcgttcaatgcccaagaccacgagtggtaacaggattaccccgtccatccacatgatattcaaaaagttggcaaccagaaatccggatagaccatagctaatactgaagacaaagctataccagcggccgcccgtcagataattcgccaacgcttgtgctgccatggccgcggtgctgtatttaagcgcggtcacgaataaaaccgccaccggtaatgcggagcggggaaccagaacaaatacgaggttaaacggacttagcaaatagtaagtccagttggcatacataccgccgccaagactattggaaaaagaataagctttaccggcagtacccagcagtgcgtgttttaggtaagtaaagaagtcgacatattgaacggccgagtcattagcaagaatggatgatgagccaaacggagccatttttaaagccgcaaaaacgatgaggctgatgacaaaagtgacgccgaaactaatgaacagtagtggccaggttgattgtttgtttgaacgcgacatatcagacgaggactcctttttgaaaaccttgaaaatcaaatattgttattaattatgatagcaagcgaaatagcaggttaaaaaatcaggtaaccttaactattaattaaatcataacgcagaatggctcggcacgcgatcgtcaggaactgagcgcgagccggcgcgcttagaagtcggagtgtaagtggcctcaggcgtgatgaccgtactttggtcattgcgcctgaggtccttacacgcagacttctgcgccggggagcgcgttatggcaagggctccgttcctcggcacacatgacaacttacgatttgaaagttacaatattgggaaagcactaacgggaggattttcatgcgcgcggataccgaagattcgggtttagtttcacagcttaaggccaatgcaatctggctattgccacttttagcgattattttggtgttgcttgtccagtggccgcagttacatctgacctacattttccatcaggatgatacgatgccgcagttacgccgaatggagagttatgtgaccagcgtccggcatggtagctactttccaaaagtctttcccgaagaagtacgcaatttcggctatgcttttgatgccttttacccgtcattgttgttattaccatatgtctggttgcgactggcagggatggggattgtcagtgcttattacggctatcagacgctgattctagtggcaactgtggtcacggcttacgttagttttttgcggattcgccggcagccactggcaggattcgtctttagtctggtttacacaacagcggtttatcgggccttggatgcctttgtacgcggggctttgggcgagaatttggcgtttattttcttgccggtgattgctgcaggtatgtatgaaatttatgccaagcagtcgcgtaactggttcttgctggcatttggcgtgactgggttgatgtacgcgcatatgttgtcactcgtgatggtgttggtatttcttgtcggcggattcctggttttggtggcgttgcagcgggtaacgtggcgcatggtcagatatacggccatggcagcggtgagtgcgttgttgatgggcttaggcagttatttgccaatggtcgaactttcccggcacctgtcacttaaactcgcggattcagcaacgatttggcccaattatcttcaatttaacttaggtgatttagtcacgaattcattgagcatgtatgcctcaaccagcagcatgcaaaatgtcaatcaggcttttcggccggggattggcgtcttgatgcttgtgacgggcattgcactcgccattttttgggggaagttgtcgcgggcagtcaaagttgcggctggtttgggctttattggtatttttctaagcacggatttatttccgtgggcattatttagcaaaaccgtgttaggcacgattcaatttccttggcgatatttggagttagtgaccttattcttcagtctggcgcttggtcttttggttgcagatcggccgcaaccgcaaccattagcattggggttggtgctggcgacttgcatcgtcggcttcagctatgccgttaatatcaacacgaccatgatcaatgccaacacttaccgcattacagataaaaatgcggtttcgtactatcaggattctaccggtggcggaagtgaatatgcgccgcgagaatttgacatgaccacattctttaagaagaatcatcagacggttttggcttcacataaccttgagcgtgttaccaccccgacccaagactacaatgacatgcaattttcgtacacgagtcggcgtaccgtgacgctaagattgcctaagtttgcttatgttggttacacggtgacggttgacggccgcccaactgcctatcacccaagtggcaaacttgcccgtatcacgcttcatgctcccgcgggcacgcatcatgtgcgggtggtttacacaggaaccatcctgcaacatgtgaccgggtggctatcgctggccgctgcgtttgtctttttggcttggtggataatcatgcaagctcgttggcatcgggatgtggacgagatgctggattagtgagcttgcggaaagtgttgtcggtggcatcgcgatataaccagaaaaataaggcaagctgaccttgattttgcaaagtcggcttgccttattcacttaatctcgcgtgcaatgaaaatggggcgccttttggtttccaaatagatgcgaccgatataacgtcctacgatgccaagtgcaaagagctgcaggccgccgatcatcagaaagatcgagaccatggaaggccagccggatgttggatcgccgaacaaagcggcacggacaacgatgaagatgagggcgatgaacgcgccaatgaagctggtgatgccgacaatagaaacaaacgttaatggggcatcggagaagtcgatgatgccgtcaatagcataacggagcaaattggagaacgaccaactcgtttggccgtgttggcgttcaatattgcgataaggtagatacttagtcttgaacccaacccagctgaaaagtcccttggagaaccgattacgctcggtcatttggacaatggcttcaaccacttgccgcgtcattaagcgaaaatcgcgcgcgccgggaacgatttgcgtttgcgacactttgttgatgaatttgtagaacatatccgaaaagaaggaacgcagatgagcctcgccagaccgatccacgcgctgagctccagccatgtcgtagccttcttgtaaaattgcgtacatatccggcagcattgatggcggatcctgtaagtcggcgtccatgacggcatagtagtcggctttcgcggttgaaaggccggcatacatcgctgcttctttaccgaatgagcgggaaagatcgatataatgaacctgatcgtctttggcttgcaactgcttgatttgatcgagggtatcgtcagtggaaccgtcgttgacataccagatttgcggttgcaattgcggcaagttttcacgaaaagtcttgatcaatgcctgataaatcagtggaacattttcggtttcattatgacagggaataataattgccacgctttgcggcatgaaacggcctcctcaatttcaagttaattctcttaataagttgatgattcctagcaaaatcaatactcaatcatcatgcatcgttttaacggccttggccaagctatcggcctgacttgatacggttgtcaggttggcggtcatgacatcaatttgctgattgagtgagctgtaatattggtttagttgggaaatttgtgtctctaggtcggcttgagacgtctcttcactgtcagcagtgttatcaaaaaaggcatcttctgctgtctgcatttcgcggtagtagctaaccagcgttttgtgatccaatttggcgagcttcagacttgttagcactttgttgacttgagtttgaggggtatcatcggtcggctggttatttaacttagtgagcgtgttattggcgtttaccaaagcagtgttggccgcctcaagctgtttgaacgcagctgcacgtttggcgagcagttttttaacgggcccgtcatcatttctgaaatctgtatcgggatgatcttgatacgctttttcaaacgttgatggaaacgcgccgacgctatcgccaataatttttagtgcagcttgttctttttgcacttgtgtttgaacggtagcggttgtggtttttaattgttgtttagggtttaaagtggccgaacatccggcaatcagaagtgccagacccgcgagccatatgagtatttttttcatcagcaactcctctaaatatatggtagcgtaaagccggctgaaatactagcagcagggggattgcaaataaatttcacccctgaatcctgtttcttcaggatacgagaaaaatgaagcggcaacaagttattttcaaggatcatactaaggtggtcggtcagtggaaagtttacgtgacgacagccgcggctaacggtaaaataacagatatctgagcgcacatagctgacgggcgggctaaaaaatttgtggtgtaactggtttgatgcgttcctatgctaaactgacaggtggagggtgatgacgatgcacattgggatgcgcacaatcaaaacagcggtagggacagcagcggcgatgttgatcgcttattcgttgcacttggaatattgggccgctgccggcattattactattttgtcagtgcaaaacacaacgaaggcgtcgtttcggttagtcgcctaccgcttattagccacgctgctaggattcgtgattgcgatcggggcgttcttggttttaggctacaatgcgtttgcttttggcgttttcttggtgatttttattccgattaccaatgtgttcgcggtccaaagcgggattgtcatgactgccgttttggtaacgcattttatgatggcgcgcagttgcagttggttttggattaaaaacgaacttttgctgctttcgatcggggccggggtggcgctcattgccaatctgtttatgccaagtcttgaagctaagatcatgggctttcaaaaacaagtcgaagccgagatgcgtgaaattattgatcatatgagtcagcagttaggggcagatcagcttaaaagtgcggacaattgggctaatttatctgatttgaagatgacgctggacgcagcagttgcgtgggcaaatcgacatagcgacaatcagttgttgtctgaaaacgactactatcaggcttattttgaaatgcgcgcgaatcaatatgaactgctgcggcagatgcaagatagtttggatcgtattgaaacgccggtgatgcaggcggcggtgatcagtgatgccttggcgatgacagccagtgttttgaatgaagacaatccggcagcgcaattggtgacaatggtgaagaaaattcagcgtgattttgctgcctcacccctgccaacggatcgcgcttcttttgagagtcgcgcccggttgttttattttctggaggatttttcccggctgttgcagttgaagcggaattttaatcatattatttcttcgcagaattgaatgacaggtggcggatttttaggacttgagatttgggtaggttgcggttaccatagcgcgttcaccggcgcagaagtctgcgtgtaaggacctcgaacgcaatggccaagcccgggccatcacgtccgaggccacttacactccgacttctaaccgcgccggttcatgctcacctttctacttgcttggtttttaccgtgatgttagactaaacatgtactttttgaatggtcgtggttgcatggtttcaggactttcttccacttgtaccaaacagaaatacacgatattatcatgcgtcaataggcgcaaggaggaatgttctcatggaacacggcacagttaaatggtttaatgctgaaaaaggttacggttttatcacacgtgaagatggcagcgatgttttcgttcacttctccgcaatccaaggcgaaggttacaagacccttgaagaaggccaagcggtaacgtttgaagttgaagacagcgatcgcggcccacaagcggttaacgttaacaaagactaatttaaaagtttcaaaacaaaagtgtactattttgaattttatttcaaaatggtacactttttcttttgattaggtgattagcgtttagcgcttcaaggctcagaagtcccgtctggcaaactcgggatcagataacacgtaagttcaatcaccgtaaagcacaagtattgccgtggtttgtaatgacacatatacgtggtttgtaatgacacatataattacaggcgaaagggtgacaagcatgactgttaaaacttatcggctaggaaactcaattgtggttaccattccagcgttcattcaatattggcgaaaacgttgaatatcaaccgattattgacgaaaatggcgtcatcagcctgctacctgttaagcatcatatcttcaggggtgatgctggctacgatttacgtcaggcaatgctggaagaaaatattggcgacaatgatattccaattggacgtgaggacgcctggcatgaatagtgatagtcagatcccatatcagtaggcaggttgggtatttggatacattaaaagatcgttcatttatgtctgtctatcaaacattcaaaaaggggtctacactttttggcattggtgatatatcaacactaaagatataggccttttttggcgatggagagcttcataagcagctgttcatggtaaactgataggtagcagttataagcttaggattgggctatggaaggcggggggcacatgttaagatttgaagaagtagcacctgacgcaagactccaatatctggatctcttgttggtgggcgatgaagatccggcgatgcttcagcgctatttaggtgcagggacactttttgcggccactgatcagcaggtgccggttggcgttgccatggtggtggcggtcaatgcgaccacggtagagttgaagaatctcgcggtcacgcctgcccgccgccgtcaagggattgcgtcaggattattgcggcatgtcagtttggtgtacgccgagaaatatcaggatatgctggtgggtaccggagatgctgattttgataatcttcggttttatatgcgccgcgggtttcgatttgattcgattcgcaagcatttttttgatgaatatagtcagccggtttatgctgatggcttgcgattacaggacatgatcgtgttacgccgcaaattgttgttgacgcgtgaggataagacaaaggagtaaggctattggcgaaaaagcgccgacgttttaccttaaagaaggttccattggcggcttggctggtcatcgctttttttgcggttggttcaatgttggttgtcagctcgtattggtcgcaacggcaagccgaagtttcacaacgccaagcaattgtcgataagaaggcggctgaaaaagcgaagaaagaggcttttatcaagcgattggtaccgacagcccaggccatgcagaaacagtatggcgtcttgacgagcattacgctggcccaggcgattcttgagtctgattggggaacgagcacgttagccaaggattaccataacttatttggcattaaagggacggatcctgccaccacgaaagtattacggacgaaggaatacgttaatgacaaatggatcacggttgacggccggtttcgggtttatagcgatgatgctgcttcgattcgtgatcatgccttgctattcgttaacggtaccgactggaatccgcagcagtatgcaacggtgcgggccgcaaaagattataagactgctgcctcggctttgcagacggacggctatgccactgatccggattatcctcagaagctgattcatttgatcgaagcatggaatctgactcagtatgacaattgaatgttcgtattttgttgattattgaatcctcgttatttggttatggtagcgccaaattgcgggggtttcgttcttttatcgctgtgaaagcggctacttagtttgttcgggaattagtgagcttgtattgttccacggcgttttttatggtaagctgattgaaaatttacaaataaaaggagtgcttgtggtgaaattactggaagaccggattaaaaaagatggccaggttattggaacagacgtattgaaggtggacaactttttgaatcatcaagttgatcctgatttaatggctgatcttggtaaggaattctaccggcgtttcagcaatgagccgattacaaagattttgacagttgaaagttctgggattgccccggcgattgccactgcgatgtcgtttcacaagccgctggtgttcgcccgcaagcataagagtctgacgttgaaggatcacctgtacacggcaacggtttactcgtttaccaaaaagacttccaatgagattgccatttcgcggaagtttttgtcggctgatgacaatgtgttgattattgacgactttttggctaacggacaagcagttgaaggattaatggatattattgatcaggctggggcaactttaagcggcgttggcattgtcattgaaaagacttttcaaaaaggccgcaaattgttggatgacaagcacattcgcgtggaatcattggcgcggattcgtgcatttgaagacggtcaggttgtttttgaaccggaggactaggctcgaagatgaagaataaaacaatttccaatccaaaagcagcggcattggggctgcaacatttattagcgatgtattcgggttcagtgttggtgccgattttgattggggcatcgttgcactttacctctgagcaaatgacgtatcttgtctcgattgatatcttcatgtgcgggattgcaacggctttgcaggtgtttggtaacaaatatttcggcattaaattaccggttgtgttggggtgtgcggttcaggcagtggcgccgcttattatgattgggcagaagtttaacttccaaaccatgtatggcgccatcattgttgccggcctgtttgtttttctgatcggcggcgcgttttctaaactgcgctttttgtttccgccactggtgaccggttccttgattaccgtgatcggtctgtcgctgattccggttgctttccagaatctaggcgggggttcgacgacagccaaagacttcggcaatatgacgaacctgtttgtcggcgcatttacggtattactgattttggccattaatgtctgggggcgcggcttcttgcattcaatcgcgattctggtcggtttgattgcgggcacggtcttaggcgggttcctcggcttagtcagttttcagccagtcattgaggcaagttggttccacgtcccgacgccattttactttggggttccacagtttgaatggagctcaattgtgaccatgattctgatttcaatgacgtctatggttgaaagtaccggcgttttctttgcactaggggatattgtcgggcgtaaaattgaagcagatgacctgaaacgcgggtatcgcgcagaaggcctagccgtggtactcggcggtttgttcaacactttcccgtacacaactttttcacaaaatgtcgggttggtgcagctttccggaatcaaaacccgcaagccagtgatttattcggcagttttcttggttatccttgggttgctgccgaaaatcggcgccttggcaacgatcattccggcaccggttcttggtggtgctatgctggtgatgttcgggatggttgcggtgcaaggtatccggatgctgcaacaagttgattttgaaaatgataagaatctgctagttgccgcgatttcaatcggtttaggcttaggggtaacggtacagccgcatattgttcagttcttgccaaaaaccattcaactgttgtttggatcaggaattttgatgacaagtctgagtgcggtattgttgaactggttgtttaattcaccaagtcgtcatcctgaaatgccggttgatcgcgggttaaacgaacaggattcagacaaataaagtcaaagcgaggaacaattgtgacgcaatttattagtccaggcgcaaccatcggcattattggcggtggcgtatcagcttttcgcatggctgatactgctagcttaatgggcatgcggactgtggttttagcaccgacgcaaacggatattgctttggaaaaagccgatattcctttggtcgggcaagcggatgatcgggaagcattaaaagagttgacgcaactgagtacggtcatgacctttaccgatgaaaacgttgacggcgctgtattggctgaattagcaaccagcagtcaattgccgtcaggaaccgatattttgaccgtgacccaggatcggtacttggaaaaggtctttcttgacgatctcaacatgaatattctgccatatacccaagtcatcacgcctagcgatattaatgaggcaattgacaccattggctatccggccttattgaagccaattcaaaaggggatgggcgtggatcagcagttgttgctggcaaccccggcggatgtcgatcgtgccaaacaattgctgcagcagcgtccgtacattttggaagcctatttgcaaaatattaaagaagttgccgtcatggtcgccaaggccgataaagaaatccgaattgggccggtgattcagaattattttgaacatcatcaactcaaagcatcttcggttcgggctgacgttgatccggcggtaattgttgagattcgccgcattgcagaaaaaattgccaagaagcttgattataatggcattttcagtcttgaatttttcttggcggctaacgggaccctgtacgtcaaacgggttttcccggggccaaaattgtatggtcacctcatgcaatgtaccagcgatatttcggaatatgaactacatctgcgcgcgattctcgactggccgctgccagaactggaattggccgaagatggcgttgcgattccgttacggcaaaaagacatggatgcggttttgacgcagattcaaattaagccggattggcggtttgctttctatccgactggcaatgagttagtcggcgagattgaaatcgttggtgatttgaaagcgataaaagacagtatcaatgccacgggacattttgtgattcagtgaaggttctcgagcgtgtcggctgcatggaaaagtcggcacgctcaccggtgatacgatgatgagtatagaacatggcgcttacaatagaggaggaaaccacctgtgattccgcgttatagtcgtcctgaaatggcggcaatttggtcagaaaaaaatcgttatgctgcatggctgaaagttgaaattttagcggctgaagcctggtcgaaactaggcgaaattccggaagccgatgttaaagctttacgggccaacgccaagtttgatgtcgatcgaatccacgaaatcgaagcggtcacgcaccatgacgtggtcgcatttacgcgggacgtttccgaaagccttggcgaagagaaaaagtgggtgcactttggcttaaccagtaccgatgtggtcgatacggctcaaggttacttacttaaacaggctaaccagattctacgtgcggatttagccgcattaaaagcaagtttggcgaaactggcaaaagcccataaagatacggttatgatgggacggacacacggggttcacgctgagccaacaacattcggtctggttgttgccacttggtattcagaactgaatcgcgatattcggcgatttgaagatgcggcaagtgatgtcgaagcaggaaagatcagcggtgcggtcgggacttttgccaacacgccgccagctgtggaagcttatgtgaccaagcagttaggcattcgcgcacaggagatttcaactcaggtattgccgcgtgatctgcatgcccattacattcagacgctgggcctgattgccacctcagttgaacggtttgccttgcagattcgccatatgcagcggaccgaagtacatgaagtcgaagaacattttaataagggtcaaaaaggttccagtgcgatgccgcataagcgtaacccaatcggctcggaaaatgtctccggattggcgcgggtgattcgcggctatgaaacgccggcactagaagacgtcctactatggcatgaacgcgatatttcccactccagtgccgaacgtatcatgctgccggacgcaaccggtttgctagattacatcctgcaccgtttcacgagtattttggatcatctggatgttttcccagagcggatgaaggccaatatgaacctcacacacggcttgatttatagccagcgagtgatgttaaaactcatcgaaagtggtttgagtcgggaacaagcctatgacctagttcagcctaagaccgcgattgcatgggacgagcaccgcgacttccggccgctgttagaagccgatccggaaattatgggccggttaagcgaggctgacttagacgatgcgtttgattatcactatcatctcaagcatgttgatgaaatcttcaagcgcgttggactggcttagtttcacaagtttgctcagaatatgataacgaaaattgacgctagaatttttctagggtcaatttttgtgtttaaattttaaatttgaacgacagtcgttatctggtacgctagcgctaacttttcaaaatcggtgccggtgacaataatcgcaaaaaaagaccttgcaatgtaacttcgcaaggtcatttggtgacggcatgtaatgataagacaggtggttgttgccaagcattttgaggattggcactgagcagcgattgatcggttgtcaggaccaataagcagctttcggtttgttgcaaagcatggttggcttcggttaagaactcgcgggtaacttgcggatcaaaaatctcggcatgaccgcttaatagtaaatatcgttttttacccatcaaaccacgataaaattgcaaatagatccgttgcaacgtgtttaaagtggccgcgggttgatcgagaaccggagaagtattggcaagccattccggcaaaaagtccgtatgcttagtgtgcccattgatgcaaaggttattccgaacactgagataatccaagataccagtgtcgcgactactgatgaaagcaagttgcttgatgaggccaccattaataaaatccttgatatattggtcgcgtaatgcggtcagtgcttcctcatccgggacgtataaatattgaatcgttttgggcgcgaaaagctttgcaagtctttcacgatagatatcaagctgctttgaccgaaataacatagctgtctcctaacgcggcatgacaagccgtttgcgaataatcgaaagcggggttaccaagcctagattggtgacgaaaatcacgccaaggccgtttctcaatgttgtcaagaagccggccggttgggtgaggtcgtccgttttaccgccgtaatagaataaggtttcacgcgtaaagccagttaggtgacgggcaaagagttgctgaaaggcgtgattcatgtcaattccacgatagccttcctgtaaaagatgaccaaaagcagaacgattcgcattggtcagaagctgaatcagctgatcattaaataaaataatcagaaaaacactaatgataaagctgattaagaaactgaaaaatgcttcaaacgcatattgtaacccgatggacatgctgcttttgccgaccaaataaagcgcatcggtttcagaacgtcgcagaaaccacagcaaggccgtcccgatcaaccagcaaacaccattaatgatgacgacacgatttaataatgtttgcgtgatttgcatcattttaatatgggcttggccaacttgcgtacttagcagaatcgtttgtttattttgggcaccaaaagaatttagccgctgtaaaaaagcgctttgtgcggattggtcgatcatttcactcgttatcagcatgatgctgatcaagcagaacgcaactgacagcagcatcatcacaaagtaataacggcgatgataacggaaacccgagaacgttcgctcaaagaaatgcatctacccgttcacctcacaagcagtataagcaatgaatttgaacaaagtgtgaacataaaccgagcattcactatgttatttgattcatttgagctggttattcttgatattgagggtactggagctgctagatgcactgctgctagcggatgaatcggtttgattttgaactttttccggaaaatcggtgatcggtgaggtgtcatctgctaattcaggcgcatcggtttgataaagtccggttgttgattggtcgttattttcgctataaagactcgtgctcttgctgccgcgaccgtgttcaattgacagcacattgctgagactttgattgtaatcatactggctgggattaatcggtttaaagcctaatggtacatagaaacgcaatagattacgattagcaacgtcatcggatagactgagccgcgtgtcgactgatttctgctccttatcaatggttgcttgtaaggctggcgtcatggtgacgagcttgccagtcgtattatcataaactttgctgcctaaaacagtgtacttcggcgtgacaaaaatgtgatttcgaaaagcaacgacattgtcatgctggttggaaagcagatcggtaccaaattggacgtagcgcttactgctgatcccaagcaaatgcagtagcgtcggcagaacatcaatttcaccgccataggtattgttcacgccgcctttaagacccggcatgtggaagattagcggaacccgctgcagttgggcatcgtcaaagccattccagtcactggcatctttacctaacaatggcgctaaggtggtattacgatcgttgctgatgccaaaatgatcgccatacagcatcacgagtgaattcttttccaaaccactggctttcagataattaaagaattcccttagtgcttcatcgaggtagtgagccgtcttgaagtaaccgttgatcgtcgcgtcatcagtgccggcatccgggaaatccgaatccgcctgggtaatataaaatggattatggttactggtcgtaataattttagtgtaaaacggttgctggagatgctctaaatacttcggtgtttctgccagcatcaatttatctttaatcccatattcggtggccgctttttcatcatgattatagaagttaccggaaaagtaattgttatagccaagactcttataaacattatcgcgattccaaaatgaagcggagccgccatggaagacagcactggtatagccagcgcgttgatttaaaattgccggggcgccttcaaacgtattttccgttcccagactgctgaacaaggatccattggcaatcccgaacgtactggtttccagcatattttccgcgtcactggttttgccgagtccgacttgatggaagaaattattgaagcttaacgtgtctttttctttaatcaacgagttcagaaatggtgttacttcttgaccatcgattttttgaccgatcagaaattgttggaagctttcaaggtgaatgatgatcacgttcttgcctttagcggctccgtaatagctagcgttaggagcagcataatgcgaacgcgtgtattgtagaaccggatcgagattcgcactgtctgcctgagcccgtacctgattgttttgcgccgttttagctgcgtcgtaaattgtaaaaggcgccaaaccgagatatttgacgatgtaattacgatcaaaggtccgcgtcagcaactgtggtcgattcatttcactcactgccgtcatcaaagcaaaaaaggcaatgccaaaaaccgtcaccgcttggggcagatggaagggcaggcggctagtatccaacgacagcccaaaatgcggccacttaagccgttgattatggatgtaacgccaaatattccagatgctgtaacctaaataagctaaaattacgatcacaatgtccagaatataaattaaatcgtggggtttgaccatgcttaaagaactggcgccgagtccttggctgacttttgacacaccaagaatcgttgtgaccgtcaagaagtcggtaaattcacgataataaaggatgttggcgagcaataataacgtacttaatatgtagacgagcaggccaatagcgtaaccgcggcgggcatgcttagggtatagccctaatgacaggagaatgatgcccgttcccagcggatttaagatgagtagggtatactgcagcgggtcattcagcccgagcgagaagtcaacgaaatacccgaaaatcgtttttgcccacaataaaaaaagcagcagggctaagaagccgattcgagtattgcgtacccattgtaaaagttgattgagtcgtaaccgtttcaaagcggcaactcctttccactttgttctttgtcattgtacccgcaaaacggcaattgcacaaaaagagacggtaagcgcgagccggcgcggttagaagtcggagtgtaagcggccttatccgtaatggcccggtcttggccattgcggataaggtccttacacgcagacttctgcgccggggagcgcgttatgggcgtaaaagcagactagtaaccttgagcgtgctcacaggcttttgatcattgcgtctaaggttcttatgtacaggttccgggctggtgaacggggaaccgccaatgataattgctgtattcaatagcgtaccgcagtttgccttaacctaggcattgacggctgattcttatggagtctttaaaagttgcaacgcttgtgggtatcacgcgttgtgtttgctacaatggcaactggaggtatcgccatgctttttttggggccattttataactggattaattcaacgtctttgagtcaggtgaaccattttcctttggtgcggctcattatttttagtctggacaagaccatcctttacctattagtgtttgccgttttgcgatgcctctggctggttcgacatcatcggcgaacgacattcggacgcgaactgaaattgggattgtttgtcggctatttgatgctactgtttgcactcacggtttttcgcgatgtgtactatccgtggcaattggtttttcattggcaacgctcactttctgtcattaatctacagcccatggtcgaaacgctgaaattgcggcaggccgccagtcattttgacttatggtatcagtcgttaggcaatgttgcctggtttatgccgctgggctttggcattccttgggtcagtgtgcatcggcggcgcttgtttgccgttgtcgggatcggacttatcacatcattaagtatcgagacattacaattcttgctgattagcggcgttgctgatattgatgacgtcatctttaatgttatcggcgctattttgggatatgccttttaccggttattgcatccaaaaggttaagacggcggtcgtttcaattgaagcagtcaagcaatttttcccagcactaaccgcctacctgcgcgaaaaattcgacttgttttgctgggaaaagaacgatagaatatttttttgtgttctattttcgataaaaagcgcgtatatctgcaggcgcttctgtataaagactttctatggaagaaacccacgttcatctcacgtgtaaagtcgtttatatgaagttttctaagcaggtgtattcgtactcagttaaacgatacgataaagaaagaggcgcattatggtatttttacttgcgttgatcccggcacttgcttggggttccattggcttggtcagtggcaaacttggcggcaatgcctatcagcagactttggggatgacgtttggcgcgctggtttttggcgttggcacgttattgatcatgcatccggttcttgacgctaagacctggctgcttggcattatttcggggttattttgggcattaggacagggacaacagtttcagtctatgaaatatatgggtgtctcaatgaccatgccaatttcaaccggcatgcaactgattgcgaccacgttggccggtgcattgctgtttcatgaatggcatactggccgtgatgtgttgcttggcatcttggcgctggcgttactaattattggtgcgacgttgacttcgcggcgggagcaaaatgatgacttcacctcggaaaccggcgtcgctaagggtttgcggacgttactgatttcaacagcaggttatgccggctacacgattattgtcaatgccggccagcttggtgctttggcagtggtgatgccgcaatcgcttgggatgattattggcgctttgttgatgagtatcgggcatgagccttttgctaaagccactgcgaagaatgttttaaccggactcttgtgggggaccggtaatgtgttcatgctgttgtcaatggcaaatgtcggactggcagtttcctattcactttcacaaatgggcatcgttatttcaacgtttggatccatttacttacttggtgagcataagacgcgtaaggaaatgatctgggtcagctgcggttcggctctcgtcattcttggcggggtcgttttagggatcatgaaagcaaagtaatctgatgagaagttgctggattgcttgcttttttacaaattcaattttaaagttaacttgttagagtgtgaatttgaacagcgtactgcactggcgtaaacttttggttggaagcggtgccgctatttttgatggcgatgccggtttgatcaaaagtttcacggtaaggtacgtatttagaggaggaacgcacacgatgtcgtacatcaaatttgattcatctaagctggataagttcgttcacgcgaatgaacttgaacagatgcagccgttagtaactgcagctgacaaggaattgcgtgaaggtacaggtgccggcaaggatttccgtggttttctcgatttgccagtcaattatgataaggacgaatttgcccggattaaggctgcggccaagaagattcaaggcaattcccaggtctttgttgcgattgggattggcggttcttatttaggcgcacggatggcagttgattttctttcccaaaccttccgtaaccttgatcctgagctgaagttcccagaagtctattttgcgggtaactcaatctccggtacttatttagctgatttgctcgacattatcggcgatcgtgacttctcgattaacgtcatcagcaagtccggtaccacgactgaaccttccattgctttccgtattttgaaggctaagttaatcgaaaagtatggtaaagatggtgccaaggaacgaatttatgcgacaaccgatcgggccaagggtgctttgaagcaagaagccgatgcggaaggctacgaagaattcgtggttcctgatgacgttggcggccgcttctcagtgatgtcagcagttggcttgttgccaatcgcagttgctggcggcgacattgacgaaatgatgcgcggtctcggtgatggtcgaaaagcctatgcatcagctgatttgaaagaaaacgaagcctatcagtatgcagctttgcgtaacattttatatcgcaaaggctacaccaccgaactgctcgaaaactacgaaccaaccttgcaataccttggcgaatggtggaagcaattaatgggcgaatctgaaggtaaagatcaaaaaggcatctatccttcaagcgctaacttcagtactgacctgcacagtctcggccaatacattcaagaaggtctccgcaatctgatggaaaccgttgtgtgggttgaagaacctaaccgcgacctaaccattcctgacgacgctcaaaacctcgatggcctcggctacttggctggcaagaagatgtccttcgttaaccgcaaagcttacgaaggcgttgttctggcccacacagatggcggcgtcccagttatgaccatttccattccgaaacaagatgcctacaccttaggctatctgatctacttctttgaagcggcagtttccatctccggctacctgaacgggatcaacccattcaaccagcctggtgttgaagcttacaagaagaacatgttcgcgttgctcggccgtccgggttatgaggatatgaccaaggaattgaacgcacgcctttaatcgcaagggcttgcgcgttttgaaataaggtaaataaagagctccagaatcatgttagaaaagtccgtggtgaagttttggtgaaggcttcggacttatacacaggttctggagctctttttgtgttcactgatttaggtatttttcgaattgttgatggttttctttcttttttgccggagagatttcagcatagatttgagtggttgaaatgtctttatgcccaagatcatctttgatgtcatcaaggcttaatcctgcctcacgcattaaaacggcatgcgtgtgtcttaaatcatggatacggatgtgaggaagtccagcccgattggtgatgcgattaaaagcaccggtagttgctcgagatcggagcggttgtccaaacttggcatcagacgaataggtgaagacaaaatcgttattgtggctagtagaaaaccgaaaaccttgtacattgccgtgactgaaatggcgctcatattgttgttgaagaagatcatttactcgagcggtcatgtattcggttctcttagagcttaatgttttgggacgatcaagcgctattttgccagcgtttgatccagtttcagcacgatagattcgtgttgcattgactgataaggtatttttgttgaagtcaatgtctgaccagcgaagagccatggcttcacccacacgaagcccgcagtcaatcagcgtcacaaagaatgatagccacatgggctctttatcttcttcagctgcttctataaaagatccaacttgatcttttgtccaaaagtgaagttttttggaattgtctttagcatacgcactgaactcgacaccaacggtagggtttttggtaatgtaaccaattgcaacggctttttttaacgcattgtgcaatgttccattgatgagctttactgtgttaagagacaagccatcattgaatagactgctgatgaactcctgatgttccttaagcgtgtatttggccagtcgaatatccccaattttggggataatgtatttcttgaggttatatcgatagatgatcatggatccctcttttacattaaccttaagcttggtgatccactgattaagataatcagccattaaaattctttcagtttggtagtgagagtggcctctgattatttcggactcagctaaagttgcttcttgctgggctattttttcggttggaaaacctcgccgatggatctttatttcttttcctgtctgcggatcaacaccagcgaatatatagaattcccaggcctttttgccatcttttagtttatatgagctaattgatgccatgatatcgcacttcttttgaactcttagagcttgtaattcaaacgtatgttcgttatgtccttaaaataaaagcctcattaaaaacaaggctccgttggttctaaatggatagattcttttggtagaccgtttgcaacttttatattatgattgcatggaaaggtggtggcatgatgaaggctttcaaaatccaagacgcggttaaactttattcgtcgcttaaaaaaacttacgaacgtgaagactctaaaattcagaaaatgcaagaagagattgatcgtgaaatgaagaaagcttctctgaccaccaaaccaagtgcggaacaccaaggacctaaacgacatttaaaaatacatagagataggccgaattcttaaagaatcctctttttgtgaaatgccaaagttagtcaatgcgattgatgacaagtaacttgcaatcgcaccaatatcacggggtgccaattgagaatttgtaagagtttggtgtttccaatttgtattatctgatttgttttccacgattcccattatataaagggttcgtggatttttttgtagcatttgaagttgtgatgggcttaatctaaaaagagacttttgtgcaaaaacaacggtttgctcagtggaaacaatgacactattcggcatactttttgaaaagaagttcaccattgcataaacacttctaaaattctcttgcgagcttttgtcctctgttatcttttgttctgctttttggattttcttcttcatgtcatctatttgcattttcgcgttgctggcattccttgtccttgcttggataactctcagctgttttttgtaaccatctaacttttcttctgaaacattatctgtagacaatctcagcactggatcaataatttcagggttggtaccggcttcaagagaatcgaagtcgtataaggaaaagctatctttgtaaagtaccaagtctcctggttccgcattctcaacaggaacaaattgtttttttagatagccttcaaggatctcgaccccgtaatcaccgtatactatattctctgaatactgatgcctattatgtgttgaactttcgtctgccatagagtggctatcttcggccgatcctgaaccatttgctatccctgggactccgccgctaatttttgcggattttcttccacctttagttgcgacctgagtcagtatggaggttttctcattcatacgcgtagtcagggtgctcaagccttcgtcaaactgggctaataaggaattcattaagtcggtgtcaacatagatatactctctcagtttcttttcggcttcagcctcatcatgcagattatggtcttccattttattctccttcaaatagtttaatttttagttttgcttcatcgcccacgcagccttccgcggaaggctatttctttgtctgaaaactagcccccctttatgaagtcgtattattgcatctttctaaccatcatcatgagcacgccgataatgatgaaaacggctgccaaccagaggctgctgccgggtttgtctgggtcaatgagccaatatacccaacggtgtttgtggccaaataaggctaagtagacgcctataagaacaatgatgaggccaatgaagtgtgcctcacttaatgtaactggaccattcataagtgcatctccaagaactgagcttagatttcgtttagcttgctgaactcgatgtcattgttgtatctgatcttgacggttagtgggttgcaacggatgatgacgggtcgatcatactgtaacgatttttgaaaagaattgaggctttccgtaaagcttggtatggcctcctcagcggtcaatacaacggcctttgcacgcaatagcaacgatgagtggtgtagctcattgaagcagtaaacagccaccacaggcttctctaggacgttttgaatggtagtagtgtcgcgatcagtgtaaaaaaggatttctttcagcgatcggtgtgatttaagtggtgttagcgaaactatattaggaaaaccggtatcggtatcaagcgtagctacctgcataacggtacactctcttaacagtatatcggcctgcctgatcgtagaatttgccataagtaatactcctatcttaactattaatttgatacgagtagctatgtttttaaccgttgatggtgaatcaaattcatttttgctataattagatgaatattgttcattagcgactagaagggcagtgactaaaatggaaaatcgtgttgagataaaagaaggacatgtttttgtaaatggaaccgaaattaacctggtcaatgatatacagcttcatcctgcgctgaacgacacaacgcaagttcaactgagttttaaagctacgagcctggatgtagtttatcccggatctcggcggtgatgacgttctgaatgattagtacgaaattctttatgatataatcagtgaaagataactagacattcacatagaggagcgatgatgatgaatgaagacaagctaggttatagttattcatatgatttgaaagatggaattgtcaaggtgaaggattttgtgaaatatttagagtctttacccagtgattccacaatcagaattcagggtatttcagatgatcgtccggctgttattgatgacaatgtctattttgaaaaaagtagtgggcaattggttatccaacctgattcattatctatatgatcaccaaaaaactctgtggtggatatccatgattattttgaagcttcgattgaattctacgtctagttctttatccttatgtaccacttgtatagctgacagagtgtaaagttttcctacaagaactgcgagctcatgctcttttttgttgctaataattgcctcatagttatccgtggcaatcgcatcctgataatttgagatgggacagtacccatcgtcgtcaatccagctaatttggaaaaacttgacgacttggtaaacattcttaattacttcttcgcaaagaccctttgttgggattaaagtcccgtgaataactctgttgcgtttttctgtggaatcgtacattttgttcaacataggaattgctgattctccaaatagtagtagggaaatcgttgcaaacgaagcaatagatctttctgaatacttgatagcgtgtgatttatcaatgattttgtccattggtttgtggttgtttgttgaccaaaagtaagctttgatagctgtgtttctgaatttttccaagctcgtaactgcgcttagatagcactcatagtattcttcatcatcatacgctcgtaaagcattttcaaatatcggaacatacagaggggtgcgtaatactgcatgaaatgtatgacccctaggacatataaatttcagtgattcgtcatcagttacttccgcgacagcactagatttataatcgcggcattcggcacacattgtttcaattttcgtgtcagacatctccttacattgtactgaccgtgtttacttggtttgcttattagccctcgccaccggggctatttttgtgcccagcaaaagccccaagtaggggcctgtaaaagggctatttcatattggactgggttttcccgcttaaagcatcatttgtaaaggtcacgttgaagttggaacccagatcaccttttacaccagatgtataaccggccacaacattcttttgaccgccgataaggctttcattgtagtagtcgggttgtccccattttgaggtgaagtcagcgtattttgtaccgtcctggaacgcgttgaaatctgccaaagtaatcttttgcttgcggcctaacttgaagccagtaagattcttgctgaacgcatttccgtcggtgaaggaaacaattacgttagctccccagccaccctcaacattagtccacgttacaagatcagtcttaactccatttgtggtactgctcgaagtagaggacgggttcccaaactgggcttttaaatcatctaatttggcaccaccattgccgttttccatcaaatcacccaatttgatgctgtcaaagtctgctcgagtaatcttgccgctgtccttttttgatgtacttgaagatgatttatccgttttgctaactgcggttttttccgtggattcgctgcttgatttgcccttattgttgaggccaccgccaattgctgctaccacaacaataaccaatatccaaaaccacacacgtttgtaaaaaggcttcttcaccttatattgcttaccgtcagcacccattaccttttttgccattttgttttcctccataaatagttttcagcttttaccgtcttccgtatctggactaacaattaattaatgtaaaattcttttattgcttccaaagcagtgtcttccattggtgcaggaatgtcaaaagcttccataaattgattcaggttagcatcttctttatcgatgtaagcaaagtataagggaacgagaatctggattcctcctatgttagcttcaccttcaatactattttttgatgctgaatagaaatacagacaagctggatcttgatgtagaacgtgcatgatttcgtgtgcagcctgataaggcaattgcttaggcttgtgccagttcatattaaccgcgatccaacgtgtttcaggattagaaactgacggagtgtacggcttcagctgatatgtcagctcagccccaactccacggtcaaatccgtagtttaaaacctctctcagcatgtcactagtaaaatcagtcatcatgtttgccacctcgaagaagtctcttgattatctcaagatcttcaggcggaatggggcgaccttcaaaagtcatgatggtgtcattttttgaatctgatatgtcaatttgctccggctttgagcgaacatcagtaaccccaagcaaaaagtcggtagaaacattaaagtaactggctagtttcttaatagaatcttggtcaggagttctttcgttcttttcatataaagaaacagacgctttgctgacatttataatttttccgacatcagattgggtcatcttcttttcgttcctaagttcttttagtctttctccgaagctcatcatatcacctcataggaatagaatagtgtatacaaattgtaaactcaacaaagtttaaaaaaagttcacttttttagttgacagtttactaattgtagattatagtgtttacataaagttgattaggaggtgatcatttgaacgaaaagctgaaagaacgccgcaaggaatttcatcttacaatgcaagatatttcaaatatgattggcattagcaaaggatattattcattgatcgaacgcggagaacgccgtgtcagctatgaattggcatttaaaattgccactgcattaaaaacaaagccggatcttatttttttggaatatcagtcaactttaagtaaacacattcccgctcagcgagaggaggtgacacgatgagcaagaaagaacacgacgaacaccagattcaaaactgggaagaacatgacaagagacagcttcaaagctgggaagaactcacccaggaaataactgaacatcttaagtctggagaccaaaagctgcaaaatatacacttgacgaatttgtatgacaggtacgacggcttcaaatcctacggaacattgcttgtggctgtgcttgtaaatacaagagacaccccgaaggatgccccgaaagattagtcaccatcagcactttctggaatccagttagtgcctagtgaaaatggatcttcgttgacagtgaagaccgtaaacgaatatccgcgtagtcttgctttttcgtgaacgagggttagcggactgaattgttcggtcttgtctcccatctctgcgacgatcgaaatcactccataaatggtcttcggcaaaccggtctgggtatttatgaaggttacgtcccacatttttatcacctcccttcgatgcaattatcgcactcggcgggaggcaatcacacaatattcagttttcaagttaaggaggtgagtcacatggatcgtaaggacatgattaaggatctgaccacagatcatccagaacacactgcatcttattggtcagcattcgatgacaataccttgatgcaaatcattgaactagatcataaggaggttcaacggaacgtctctgatcaacttgctatgggttaatcatagccctctctagcatgaatcaatatccaccaatatttcatcttttaaaggaagtggaacgtatgaaagcaacaattagtagccctttgaataggttcgctactagaaccaacacgccacagaaggtgatcgcttatgcagcaaaattagggcgctcaacgatcaacaactattttcatggaactcccattagagcaaacgaggctactgacattgccaattcgatgaatgacagcgaactaagctatgaaatggctaacttgtttctaggaatccctaagctgtttagcggtgacggaatataccacgatttacgcgggcttttagtcaccgataaacgagaagaagacgaggagaaagcttctttcatcaagcacgacattgagggccttgctaatgaccccaactttacacgcgatgacgctaaaaacttgaaagcatacgcattcgagaaacttgatagcacagtcgcagatctaaccgaactaaatgctatttgcgaaatgctaggcatctcaatcatggatcttttcagcgaaaggctcccgcattaccagaaacttcattatatgaggaaggatgagcaggcatggaacaaggatttacactgatcgatcccactaagccgcaaaggacacgcaagccctttaagcccaaagtttattggacgccaaaagatgttatggcacactatcaggtttctgccgcgacagtgagccgttggaagaaaaaaggtgctccatttgtcggtcccggtaagacacaacgtgttgagccagaaaagatggaacgttggtttgcacgtcagcagggggtataggcaatgctagaagcaatcttatcgatactgctagacccgagcgcgttgttctggaaattctttattgttggcatgttcggtatcctgatcggtgccacggcggtgggcggatggaagcagtggattgaataggaggaaagcacatgcgagataccaaagagtattggcaagacgtgcacgatcaggtcgaaaacgtgatctataaaggccatgctgatcgcggttggctttggatgttcgaacttagtcaacggatgctcaacaaatgcgcacaaaaaaatcccatggcggcaaccacgggacatgaaaaacaaagcaaattaatttataggtcaagtttatcacgaaaaggaggtgcccgccatgcttgaaccagattggaacacggcggcattgaacgagtatcaaaatcgccaggcacgacaagaggaagagccacctctggattggcaaggccatcgctggttgatggcgagacctaccttgaataccacgacgaactcgtcaacgaatatgacgtcattgacttcttaatgagccttggcgcgactgaatatgactactaggaggaacagaaatggctaatgaaattgtagcaagtgtcaacaaccgcatcactgagatgcagaagaatgaaggcttgaaacttccggcgaactatagccctagcaatgcgctgaattcggcttggctcacgctatcagataacagcaaagggccatcgctgttagataaaactagcccgcaatcgcaagctaaagcattgcttaatatggtgattcagggtctcagcccagctaagaatcaggtttacttcattccttacggcaaagacctgaccctgatgcgctcgtactttggtagcctggcgatcctgaagcgtttggataatgtgcaggatgtttgggccgaggttgttcgggaaggcgataaattccaaattggctctgatcgaggccggacggtcgtcaaagtattcgagccgcgtattgagaatcaggacaacgctattgccgcagcatttgctgtcatcgtcgataacaatggcgttgagaacttcaccatcatgaccaagaagcagattgatcaaagctggagtcatgccaaaaccaaaaaggttcagcaagagttccccgaggaaatggctaagcgaacggtgctcaaccgggctgccaagttcttcatcaactcaagttctgacaacgaccttttacttggggccgtcaatgacaccacggccgatgaatatgacaacgcggaaccgaaggacgtcacgccaaactttgatgacctgattgatagcaagccgaaggaggagccgaaacatgctgcaaatgccaaggaaaccaaagagacaaagccaaaagaaaccagccaaccagaccgagctgagcataggccggttaccgacaaagaagtcgcgaacctcttccagaaccaagttaacaagtagaaactattacagcaatcgcatggattggcagtatcagtccccaacttggttcaaaaagttcatggcttgcgaggccgaggctttggcggaattgaagggcgagtggaagcccaagcgcgacccaacggccttgttggtcggcaactatcttcacagctacttccaaagccgctatgcgcacaacaagtttaagcaggaacatccagagattatttcaactcgcggtgcaacaaaaggacagctcaaaagagaatatcaagttgctgacaacatgattagaactttgcgaacagatcctaagttcaaagagttctatcaaggaaaaaaagaagtcattgtcaaaggcgagatcggtggggtggcttggaaaggcaaacttgactgcttagcggataaccataaatacttcgctgacttgaaaaccaccatggacatcaacaagcgtttttatctaccagaagaacatcgctatggttctttcattgaggcttacaactacccactgcaaatggccgtgtatcaggagctaattcgacagcaatatggcgttcaagccgtgcctgtcatcatcgcagtatcaaagcaggatccgccagataaagcggcggtctcaatgccgcaagatttgctggactattggttggaacgagttaaggaactacagccacgcattgaagccgttaagaacggcgaagaagaaccaaaacggtgtgagcactgtgagtattgccgggcaactaagcatctgactcagatcatcagcctctacgatctggtcgagtaggaggtgactcaccgcatggatttattcaagctaattcgagagttctacattcagcaaagcgttaatccgctaagcacaggacagatagcattatggcatgggctggtttaccaatgtaaccagctaggctggccaagcgaattcaatatgccgaatcgaacacttgaaacgttgactggtttaagccgtcagggcatcgtcaaatcccgtaacgcgctaaagcagtcagggctgatagattttcaaactaacggtgttaaggcaacgacctactcagtcatcgatatttcacgaaaacttagtacgtcagatagtaggcaacctagtagtcaagatgatgacagtatgtcaaatagtaggcaacacggtaggcaacctagtaggcaacacagtttacaaggtagtttacaacctagtaggcaacacagtagcacatacactaaacaagacgagactaaactagacaaaactaaacgacaacagactactgctccagtaaaggcagcagagagacctgctggagaaccgtcatcgtcgtcatcatcaattcttgatatttgcaatttctgggaaggaaacgggtttggacaactgtcaccgttcaccagagaaagccttgttgattgggttgctgacatgcgaaaagcaggatcacctgaacctgagaagctggtcctaaatgcgctgcggactgcggttgaaagcaatgtcagaaactacaagtacgtcaacggcatcttgaaaaactgggaaagcaagcgtcttctcacggttgctgctgtcgatgcaaacgatagtgaacgcaaaacgaatcagcctcagcgccgttacggcaagccagttcggaatgagaaattgcctgattgggctaaaccaggttacaaaccagaacacaaaaaagcgtccgcagaagacagagccgaattggctgagcaattgcaaaagctacgagcattgggcgaaaagaattaggagggaagcatattgctaaacagtgtctcactaacaggccggctgacaagagatgttgacttgcgttacacgcaaagtggcacggagacaggatcattcacgctggccgttgaccgcaaattcaagagcaaaaacggagaacgggaaactgatttcgtaaattgccagatctggcgcaagtcggctgagaactttgcaaatttcactcataagggtgcacttgttggcatcgaaggccgtattcaaacgcgtacgtacgataacgcgcaaggacagaaagtgttcgtgaccgaggtaatcgttgataattttgctttgcttgagtcacgacaggcgtctcagaacaaccctaaatcacagcaaacagccaatgcatcagcagcagcgaccacgaacgcgagtcaaacgactccaaatgcttcacgagcgaataccacggatccgtttgctaataatggccagccgatagacatccaagatgatgatttgccattctgattggaaaggatgaaaacatgtggcacatcattgaaaggcttatgcgtgaaaaaggttacagtatcaggaagttttccagagttgctgggtataaaaatccaacaactatttattcaatcaaaaccggtcaaagcaaagatccgtcattctcaacgatgatccgaattgcggatgctctaggcgttagccttgacgaactgaggcctgataagcaaggagagaagaaatcatgagcggaaattcttatttaaagtctgttagaaaatctataggtttaacgcagcgagaatttgctaggaagatcaaatgctcacaatctcactggatcaaagttgaagacggtttttctaatccgagtatcaagctattaaagcaaatcaaaaaggaatttcctgactttgatctcaacaaattagtctgattaaaaaaatccccagtcgtgtcagcaactggggaccgcgaaattttgatccgttgacaatctgacactcatcttcatcacttcactggtatcgtcgcccagtactgctgatgaactgattcgattgttgtcgcttcattgacgcccacttgcgcacgcatcgatgcacctacaataacgtttgcaggaaacgaggacgcaacaacttcaaaccattacttcacagttagcaccaaaaatgattccaatggaatcacccctttgttaagagtatttggtaccacacaattatatatccatttccattttaaggaaacgttgaaaaccacatttggcagaagccaaaaattgttagcaggaggcaaaatcatgacacaagtaacagtgcgtttatacgagcagggagacaaagtgtggcgcgacttcaaggctgaattacttaagcgctatgaaaactcagcaatgctagacatctcgaaaatcaaagcattctcaaaaatcgagaagcaagagttcaacaaccggattgttgtatcaaagaaagcgattgtcgagaaacgtgcggtagctggtgttgatgacagcgatactttgaaaacttcagtcaacaatggccttgaaaagatttcaaaaaagcgaaaagaagcccgtgccaaatacgcacgcggaattgcagaagcggcctcacaatgtaacacgctgattgacgttgcaaaacggatcggaaagtcaacaacgttcgtgaagcgagttgcaagcgaatttgagatcaagttaccgcgccgcaacaacggccatgaagagatcgtgagccgttagcaatttagcgagtgagaatgcaagaaactacaggaggaatcttcaaatgcaagcaattaaaacaaaaatgatggtcggtgatctggttatggttcctgatcgagtattcatgggcgtgcgtgatcttggcggtgtggcacgaatcatcaggattgaacgatacaacgccagaggagcaagacaagatattaacaagccagttgcttttgaaaacaatgcgcctaaagagttaatcgcaacggttgagatggttgacggcaagcaacgtcaatactatctgaaggacgtgaaaccagcgtgataaggctaacgatacctggcaacccagtaccacaaggacggccgaggttcacgcgaatgggtcatgcttacgacccgactaaatcaagaaactacaagcagcacgttaagagcgtagcgtcagagctcaatattgagcctctaagcggtccgataagggtgtcaatggaaatataccgtcagcttcaaaagtctggcagtaaggccttaataaggcgaaaaaaagaaggcaaagttaggccgacagttaagccggatgtagacaactactacaagtctgtatcggacgcgcttaccggaattttgtgggaagacgacaaccaaatagtcgaaatccatgttggcaaatggtacagcgatcaaccacgtgttgagattgaagcagaagagatcgattaaggagaaaaaatcatgaacaaaaaattgacatttacagtaactgttttagcaggacttatgtttggggccggtgcaaccaccattgccgacaatgtttggcaaggtcaccagaacatcgtggagaccaaaaacaatatcgacaagctgacggctaagattcacgcttcaaaatctagcttgtccgatttgcaacatcagttgtctgacgcgcaggcacagtatgcggccctaaaacagcaatatggaaacgacatggcaaacaaagatgcccagattcagcaaaagatcgttgaaggccagcaagcagttgcccagaaacaggctgaggtcgatgctaagcaacagacaatcaacgaccttacatcacagttagaagccgccaaacaggcaaacaatgacttatcacaggcaatcaaagacgcgcagagcatcaaggactattcagatcaggctgtgaagtcagtcagcgcgaaatgagaggcacacaaatgtacgtagtagcaggattaaacacagaaaccgagtattatcgagccaagtatcaatctcagtgtatccgatggataaacgagaacatggccaagcacacggaatcgcacaacacccgtggtgatgacattaaagtcaatattccggaaccactgattatcaagaaagtagaggacgaaaaatgagtgaagaaaaactgtacgcggtaaagaacgatgatggggaatacttgaccgttgagcgtacggcaccttggtggaacagtccggtaggaaccgctgtaagaaatattgatgttgcgcttgcatgggcggaaaagtatggcggccacgttgtcacgttcgttgaggagcctaaaaaggtagtcctaaccaaggagcaagccgaaatcgttgaacgtgcacatagcggcaagttcccagcagccagcattgctttctatggcgatgatgacgaagagccgctgatgaatgcttacgtcaacggctacaccgtggcaaaggagaagaaatacaacgttaaggtgccacataccaaagaggtttggtattacaagtccggcgatacagatttgttaacgatttgcccagcggataaagaacttcgtggcaagttcaccgaagcagagatcgagcactacggcttgcaatactgcgaaaaagaagaggtgactgacgatgacgaataaagccgacatagacgctgcgcaaaaggccatcgatgccgcgaacaatgcgatcaacaaacttgatctgtgtggcctgtatgattgcgcgtggcaagcacatgatggctatcaacgcatcatcgattacaacaaggaacagttggaggtgactgacgatggcattcgttgagcttgaagacggtagctggataaacccagctttcattgaggagatatacaaacgaaaccccagtgataccgtatgggaagctggtatgaaccatggagaagctaccacaataactgacgcagatcgcattcttattctcaaacacgcggggttcgtgagagctagaaaggagaaagacaatgagcaatgagacgaagcaggacgtgttcgagaaggcactaagagaatgggacgattatgttcacagttggggacttcaaggagaagaagcacacggtggatgcgagtttgacccaatcttaattaaatatatgaaggactatgacgccgccctgccagatgaaaccgaaaagcagaaaaactgcccatattgtcatgaaaccgacccacaatcaaagcatgcacattacggcaaagctatttcagataagacagaatatttcgactttgttcgcaaaacgaagctgtacagacgggtgaaggcacgaatcaaatcaccagaagaccagcacccaaagttgtgtgtcacacaaatgaaccggtttagagaagtatcagtcgttttggataaggcaattaactattgcccaatttgtgggaggaaattatgacagagacgaagcgggacgtgttggagaaattagcagaatgctacgccgaggtttctgacgcatataccagcgaaaccggaagcccatactactgtggcgatgagccaaattatctggaggaatatggcacatccttgccagataatctgccggttattccgaaagcggtaggcgatgtgattgtaaaactcaaacacaaaaaattctctctatccggagcgatgagctacgccgcagtagtttctttatctccatggatgacgtttgaacatgaggacaccttcgcccttgcatgggtgctaggtgtatggcgcgttgagaaaaccggcgaaatcgtgaaattggaggcggaaaaatgaagttagttaaaggcgacatcattcgaaacccgtgggtgagcgacccaaaatggcgagacttcattttcattcggcgcgggaagaaatatgtgcacactttgagatctaatcgtggactaattgaagacgcaatgtttgacaaaaaagacgtggacgagcgtttcacaaaagtaggccattcagttggattcgacaccatgctgcgagaagtttctggcgaggaggcggagaaatgaaacgagagattaagttcagggggaatccggagctattggagggaaagcaatgaaaataagtccttaccgtttcatgtcatggcttggtttcatattagctctggcgtcttcatttttacctgcaaaatatatgaattttggagcttacaaaacatttactggtttgacactgatagcagtcttgtttgcactttgggacatttcggatgcaatcagagagaagcagaaatgaaacagatgattgccgtcatgctgctcatcgcaggtgcttcaatgtggatgtgggctaactggaaaagagggaaatgatcgtaaacaaaaagcgcgtctgatgaaggacgcgccggaggccaaacgtacgattgagagtgaatgaaatcaaagattaggagttggcctccaatgacagtatagcaaacgcacatgttgaacgcacgtttaaggcatcaaaaaagcgcaccacgaaggcacgcttatccccaaaacttttacaaatttaattataccataaggggtggcgcttgtgatggagcttttatcaattagcgatgaaaaggatcgggaagcagtcgaaaatatcctaaataaataccgagcagagcgtggattcataaaggcgccagtcaatccaaagatcactagtgcatggggagacggaacttctgccagcactgttcagcgtccgctgtatgcacagcagcgtttggaaagacaagaatcggcacgtaagttctgtgaatggtgcgacagttgtattgcatcaatgccgaaacaatcacatcagcgtttattaagggtgcgctattgcgatgggccagaaacagatacgccagacggtgatgcaatgaatattctcgatatatctgcagcaacctacacacgcagaaagaaaaatgcgttgttagcagcggcctggtactttggcgtcacacccagaaaaagtagtgagcaataaatgatcgatgaatgaggactatttgaggactaattgattgataaatgagtggcgaactaaaaacggaatcccttatgattgtattgtgccaaaggtgagaaacctgagacaccgcatttttcctccgagcctcagtgatgataaagctgtggcaaggcgtggcaatgaggactgaccgtgatagtcaggcgggttcgattcccgcatgccacattgtccagtttagcgaccggacacagcttgcgatgaccccatctgacactgggagagcgagcaaatcgctgtggcggaataggtagacgctgaattcagtgagatcgtcgtgtacgataaagcaagctcgtacatctgaggattcgattatgttgggtgcaaatcccgaccagcgatattaccggtaaagcccggcgtgcttgctagcgcggactagtgggtgagtataaagcgtggtcacataccttgcacttcaaggtaatgtgggaaccaccgaaaccgagggctcagaaaccatcgcctcggatagcagcaaccggaggattaactttgtggcctctattatcgggttcgactcccggcggttgcattggatcaagtctggtaaaccacatgagtaggcaccggactatggcacttcgctaaagtgaggtgctatttttgtgcaacaaaaaagccctcagagaccagtccaagggccaaaagaatgaaaaaacggaatacttgtgtgagcagcagcggttgacttggaggagaaaggccactgctcacatatatatattagcacattccttatagaagatactaaaatagccctcggttgggggccgagagcctaaagaaagggtattacaaaggagtgaaaatgagtatctgttgggaacaatttaattctaactcatcgaaattttttaagcaacaaaaaagctttcggggcctaatccgagggcttaagaactcgggaagttcttcatgagaatgtgagcagcgtcatcaaactgctcacggacattatattttcggaggcgagtagatgcagtggacagatgaacaaatcagtgacattaggaagctcgcctctgaaggctttaccagacgagagacggcagacaagctcgggattagctatgatgcgcttcaaggtaaagcaaaacggcttggcatcgagttccaaaaaccgctaaagaatgaatacgattcagacggcacacagtccagtgaaaccattctaaaagttgtcaggggtcacaaaatgacgcctagagaggttttagaagctcacgggtatgattacaccaagtgggagcttgtacgtgccacaagcaatttttggaagcagacgcctgaagcgacattgtatcaaagcaagatacaaatcaggccgctagttgaagcagaacaatatgaatcattgatgaatgacatcatcacacacaaggagccgtatcaagctaaggctcctatttttgtggaatcagatcgctatttggtcattcctgcttttgatacacatttcaacggccacacattcgacctatatgctgaatcgcttaaacggcaactagagatcattcaacgcggccactacgccaaaatattgctcattctgggcggtgatcttgctcatgtggataatatcaactcgaccacagcaaagggcacacagctcgaaacaactgacctaggcgagactgtgaacgaaatggagcaatacttcgagacactgattgaagcaatcattaagaatgccaatgagtgtgaggtcatgtatgcgccaggtaaccacgacccgtcagttggatatatgtttgcacgtctattgaaacgtgcctacagcaaccagtcgaacatcacttgggatatatcactgaagcattacaaaggcacaatgttaggccataacttcattggcgccactcatggtgataaaggtaagaacaactaccttgcaaaatatcttgatgagttcggcttcatgttaggcacagcacagaatcgcgaactgttcacggggcatctccattcagagatgagcaaagacctaggcggattcgttcagcgtcaagtatcaacgcggaaacctaatgaccgctggactgatgacctcggggttgttgcccacaaaacgtttgagctggtcgaatattcggatcacaatacgacagccatatattacgtttgagaggtgattatcatgagcgaaaaggaaatctggaaagacattgaaggttacgaaggtctatatcaagtcagcaacatgggaagggtgagaagccttgctcataaagataagtatggccgattcacaaacggaagaacgctcgcagactggtgcaatagccgcggatatcacatggtaactctatatcgagacgggaacgctaaaaaatggtgggttcaccgtctcgtagccactacgttcataccaaaccaaaacggatatccggctattaatcacagggacgagaacccaagcaataaccgagtggaaaacattgaatggtgcacagtgctttacaacaacaggtacggcactcacggaaagcgcatagcagaagcacttgaacggccaatttacgcaataactagttcggggcatcgctatttctttagcagtgcaacaaaagcagcggaactcctcgggctaagcagagggaacgtgtctacgtgccttcacggcaagcgtaagcactgccatggcttttcttttgaatgggcgggcgaccccgatgactagagtatggaacactgactacggaaatatgtacgatgttgaatttcggatcattgagaaactatcgagagaagagaaacacatgaacgcaattatctatacgaagccgcgctgtcaaaagtgccggcgaacagtattaaaactgtcacgtgtaatgccagtgcaaacagtcacagcagacgcggacgactacgaacggttccgcaagctgggataccgatcaatgccagtcgtaacagtttacaaggcagacggcacacatgatgaatggtgcgacttgcgggttgacaagatcaaacaatatacggaaggctaagagcttgtacaaatgcgggaggtgtggtgatatgtaatgcgactgacagcaaaacagaagaagttcgttgattcttatattgctgatagcaatgccaccaaagcggcactagaagcaggatacagcaaaagaacggctagatttgtcggtgcagaaaacctaacaaaacctaacattaaagctgccatcgatgaacgcatgaaacgcatcgagtctgacaagattgccaaggctgctgaggtgcttcaatacttcaccacagtgcttcgtggagaggcaaaagagacgattatagttggcactccagatggcgcagaatctgttgaaaacgagccaagcatcaaagaccgcatggcagcaggacgcgaattgttaaagcgttaccctggtaatgatgagctgctcaatgctcagctaacgaagattattactgatattgagaaagctaaggctgatgttcgcaagtccaaagctgaggctgacatcatggaagccaaggccaagttgcttactgatacggattcgcaagataggacggtgattgtcgatgacgtcccagaagatgattaagttaagtaagatggtgcaaccacatttttatccgttttggcggtcaaaggcaccatatctgatactgaacggcggtcgtggctcatttaaatcatcgacagttagtctgaagctactcatgatgcttaaaaggcaagcacagcaaggacataaagccaacgtcatcatcattcgagagaacacgattaacttgcgtgattcggtttacagccagatcagttgggccattgacatgctcaaaatgacagacgagtttgtgttcaacgtatcgcctatgcgcataacgcatcgtggaactggtagcacattctacttctacggcggtgacaagcctgaaaagctgaagtctaacaccgttcgtaacgtgattgctgtgtggtatgaagaagcagccaacttcaaatctgctgaagtgtttgaccaaactaatccaaccttcattcgacaaaagtcaccgtgggttgatcaagttcaggtcttctacacgtataacccaccgaagaatccatatgactggatcaatgagtggatcgacagcgtgagaggagacccggacttcttcattgacacttcaacttatctcgatgatgatcttggattcactgacgaacagcagctgaaactgatcgacaagtataaagccaacgactatgactactaccgttggctttatcttggcgatgtgattggattaggaaccaacgtctacaacatggatttgtttcatagactggatgaggtgccaagcaacgatccaattaggcgtctcgtgttctcaatcgacgctggtcatattaatagcgcaaccacgtgcgtggcggccgctgttacggccaagaacaacctgatcgtactagacacctattactattctccagctaatcagagcgtgaagaaggcaccaagtgaccttgtgccagagataaagtcgtttattgataaggtaaggtcaaaatacaatcatcccgtgcttaaatacacgattgattctgctgaaggtgcgctgagaaacgagtttgttaaagagttcggcattcgctggcatggcattgtcaagggcaaggaagctgacatgattgactttgtgtctaacttacttgctcaaggacgtgtgttctacttggacaatgacgacaacaagatattcatctcagaacatcagcaataccagtgggatgagaagaccgcacattctgacgatccacacgtaattaaagagcacgatcacacggtcgatgctttcaaatatatggtaatggacaacgccggacagttgaaacttagccaggccaacaaggcacgagcattcaagaacacaagcaaatacttctaaggaggtggccatcatattaacagttcaaggtaaaggatcaatcacagacggtgacgtatttatttttccagtagacacagctattactggggacgatatcaccaatttcattagcgcaaatgatgaactagctcgcagaaaatatctacctgctaaaaagatgtatcttggcaagcacaagattcttcatgaagatgccaaagaccacgggccggacaatcggcttgtcggcaacttggctcactatatcgtggatacctacaatgggttttacattggcattccaccgaagatcacgctcgacaacacacaggataataccgcgctgcaagagtggaacgacacaaacagcgttcaggacaaattaagcgaaatcagcaagcaagcagccatttacggacgggcacttgcttttttgtaccaagacgaagacagcaatacgtgcattgcatacagttcgcccatcaattcattcattgtctatgatgacacggtagcacacaaagccattgcatttgtcatgtattggcatgatgaagacaacaatctaactggcaaggtgtatctgaaagacggtatatacagccttgatatggttcgctttgaaggaacggccggatttaatccatttagcgagattccagcagttgagttcttcatgaacaccgagcgtcaaggcatctttgagaacgttgagacgctaattgatgcactggacaaggtgctaagccaaaaggcaaaccagaatgaatactttgacaacgcgtacttggttatcaggggcatgagcctgccagaggatgatgacggaaatccaaagcttgatcttaacggcaaccaaatcatctattcgccagatgctgactctactaacggtgtggccgagtttctgaccaagcctgatggtgatgccattcaagagcaccttattgaccgcctcatcagcatgatctatcagataagcatggtggccaacttgaacgatgaagcattcagcggcaatagttctggcgttgcattgcaatacaaattgctaccaatgcgcaatctagcggccaatcaagatcgtaagttcacacagtcactccggtccctttacaagatcgcgttcagtgttggaacaattctgccagaaagtaaagccgatgaatggcaaaagcttaacttcgcattctcgcgaaatcttccggagaacattaccgacgaagcagacgcggcttctaaactcaaaggccttgtatcagatcagactatgcttagcaccttatcatttgtcgatgatcctaaggctgaaatgaaacgcattgctgatgagactgccaagaaagcaaaagatgctgctgctaacagtccgtcaagcccggacttccagaaattgctgaatggtggtggcaatgatgacaacaacgactcaacaacagatagcgagtaattctgcctactggaataagcgaactgccgctgaacgtaaatggattgccgagaaccttaagaatgacgaggcgttcaatgcccgaattcaggaatattttgacaaagctttaagcaacattcaaaaggatattgattcagagtttgccaagtatgccgcatacagcaacgacagtatggccggtgcgcgtcaagcagtgatggccaccgatattaaagcatatcaagcagaagccaagcggatcgtcgatgatgccagaaagatgtacaacggcgaaccgctcaaatattccgacttcagcaaggatgtcaatgatcgtctcaagctatacaacgctactatgcgcattaatcgcttagaaatgctcaagagtgagattggtcaagaaatgcttgatgcacacatgaaagtgaacgtcgatttaatctcaaaattgagtgatgattatcaatccgagatcaaacggcaagccggaatacttggagagacggtatctaagggcggctacactgatttagccaagttactctccaaacgagagggcgattacaccttctcacagcgcatctggatcaaccaagacattctaaaggctgaactggatgaactgctgacatccgccaccattcaaggacagagtccactaaagattgctcgcaagttacgcggtcaagtggcagaaacggtgaacaatcaccgctatgtgacagaacgaattgtacgtactgagtcagctcgaattcagacacaggcgcaattagatagtttccacaaatttgactatcagtactgcaaatgggtggctgagccaagcgcgtgtgatgtgtgcaaggagatttcagaaggtggcagaactggtgaaggcatatacagggttgatgatgtgccggatattcccgtccacccaaattgccgatgctccattgcggcttatgcaccgagtgatgaagctgaataatttctaagccgcagctagcggctatttttatgccatcaagtccaagcgtgatcgactataaaagctccggtaaattaagacgcaagcctgatccgtctaaaaagctgtggaaggagttcttaacatgattcccaagattttaatgcctatgaatttgcaatttttcgctgaagataatcctcaaggcgatccgaaagatccagtcgatccgcctaagccaaaagatggtgatccggtagatcctcctgaaggtaagaagcaaggagaaccggctgaccctgatcctgatggtaagcacgtctacaccgatgaacaggtcaatgaaatcgtcaagaagcgtcttgctcgtgccgagaaggagaagcaagctgctgttgacgaggctgcgaagctggccaagatgaatgccgaccagaagaaggattatgagcttcaaaaggctcaaaaagaacgagatgagctaaaatcacagcttgccacctatgagatgggaaaacaagctcgatcaatgttcgaagatgccaagctgtcggtcacagaggacgatttgaagcatgttgtaacgcctgaggcagaatcaaccgagaccaatgttaagtggctcattgcgcacgaccaagccgtagcagagcgcgtccgtcaagaactgctgaaaggcagtacaccattggacccgtcctccaaccgcaagacgaagagccttaaggatatgactttgctagagcgcagcgaattgcaacgaaaagatccagagatgtacaagaaattactaacaaaatgaaagaggtaaataaatatgccagaatttagtggtgcaacagccaaattgaatttggtcgaacctaaagtattcgcggattatgtcttggaacagcaaactgctactaaccgtctgctctctagtggcattctcactaccgacccaatcattcaagcgcaattgctcaagggcgggacttatgtaactattcctaccctgcaaagtcttagcggggaagctcagacgtggaacgacactagcgacattactgtcggcaatgttgacagttacagtgctatcgctccacaaatgtaccaagccaaagcgtttgggtacacagactttggtcaactttccaccggcgctccggttgcagaacaaattgcaggacaattcgcatcattctggaacatccaggacaacaagcttctgattgcagtcttgaagaacgcattcctcaatgcggatttgcaggctgttaaggcatatggcatgggcacgccagcgcctttggctgctggtgactttattgccgcattgtctcgcatgggtgacgttgccagccctcaactgacgaagatcgtgctcaattctgctgctgttggtgcaatgcgtgatcagaacctgattgatactattcagccgtctaacggtggtacgccaatcagctactacaacggcattgagatcgttgaagacgatgcactgccagttgcagcagatggtaccacggacgcgttcatcattgctaacggtgctgtttcttatggcttggctaatccggaaaacagctatgaagtcaagcgcgacagtcttggcaatggtggccagactgcggttatcaatcgccgtactcttgcaatgcaaattgcgggtacgtcattcactgatgttactaaggttgccggtcttggctacagcgcaatcaatgcttctgaaacatctatgtacgatctggttggtgatcctcgcaacattggcatcgttgactatcgcttcacgatcgacaagaagttcgttgttgctggaatcaatgccccaaaagcgtagcgccgtctgggaatgacgacggcttcgaccctagcggagatgtcaaaccaacgagcgatcaaaccgttgatgagatcaaagcatggctggacgcccacagtattgattacactgggaagactttgaaggcagacttgcttgcgcttgtcccttcagactagcttgaacaccgtcgcttatgaaaatcacagtgctgcgaaagcagggcggcggaaaggaggcataacatggctgatactgatccggtaacgcttgcggatttgaagacgatgatggaaatcaaaactgacacacaagatgatgtgcttaccctcattatcaaaaatactacgcaggccttacgatttaagctcggcttgcggacagatgaggcctttcctagtgagttggcctacattgccttggaagtctgtgtgcgacgatataaccggcgtaagaacgaaggcatgacgtcttatgagcaggaggggcagtcgttcacgttcaagtctaatgacttcgatgattttgctgatgacatcagcgactggaaagaagccaacggtaagaatgccaagtctcttggcaccgtcagcttcatttctggctatccaaagaggtgatcatatgcggttagatcatgaggttacattctggcttgatgatgaagaatataatccgcaaacacatcaatacggtgatgtgaaaaaggttgccaccgctgttgccagtgtcaccgacatgggaaccgacaagagcgctcagctattcggaaactatgctcaaaaggcaaaggtgatccgattagttgagccaatcaccgtcaattggagctatttaacgattgatgatgaagcgactcattatgcccttaatacggaccgcgttccgcttcaaaacgctactttgattgtgggtgagacgaaatgagcaaagccagcattagctacaacatggagataaaaggcatggacaaattggtagcgggtctgcttagccgagcaaagatggatgttgtcaaacaaatcgtcaaacagcaggcagcacagctccagacacgtgctcagcaaatgactggcaccgtgtacgctcatcctactggtgctaccaagcgcggcatcaagttatcgcttgaagatggcggcctaacgggcatagttggcatgtcgatggaatacaacccatacaccgaaaacgggacccgtttcatgcgggcacgtcctgtattgaagcctgcgttcctttatcagaaagttcagtttattaatcagcttaaacaagcagcaaagtaggtgattcaaatcacatcaccagagcaagaactctacgattatttctatgcgttttcgcaatcatctgggtacaagacttacgaccatttgcccatgcagcaggagaacgccccgtatcctttcgtcattgttggcgatattcaagttgttcctattgcaacaaagacgtcactcaatggcaatgtgctaattaccattgacatctggggcgataaaaaacagcgtttcaccgtatctgatatggcggagcgcttttttcgtgccgcgattgggcaagttctaacagatgattaccgattttatggacgtgtagaagaccagtcaaaagagtttacacaagaccagagtgtccctgacacggttctcaaccgagccacgctgatactcaatctcaatattttataggaggccataacatggcaaatgaattaaaagtgctagaaggcatggacgttgttgccttggctcgcaaacatagcgatcaagcaacggttagcggccaaattatcccttggcagacttcgctgtcctttgatccgtctgttgacagtgattccactgttaccaaggacggcaatgtagcaacacgaagctctgcaagtaccgatcttgaggtcgagttcctgaacaacacggccgcaattgcagacgtaatgtatgactcgctgtttgatggtgaattgctcgacttctggattctctaccgcaaacgtaagaacgctgatggtaagtattacgcatggtatatgcaagtaaccgtgcaagaagacagcagcgacaacgatcctgacgatcactcgactcgtgatgtgacattctcagttaacggtacgcctaaacgcggctggactacgctcgatgatgaaactcaggaacaggttgattacgtgttccttggggtcggcaaggtcactgacactgacaataccggcggtggcacagtttgggacaaggctgttgatccgggcactaacactgctgatactgcaccagcgggcggaactggtactggagcataacagcataagagacttgtcatcagtcgcctaagaaagtcacagtacgggtgaaacccgggcggctttaaaagaaaggactttaaatcatgcaattaaccattaacggtaaagaatatgaactcaactttggcgtccgctttgttcgcgaaatggataagaatatgggtgccgtcatgcacggcattaactttggcatgggtgttgcaaaggctctagctggtctaagcgcatacgatgctgctgttttatcagacaccatttattcagccaccgtggcatctaagaaacgtccgtcagccagtgaagtcgatgactttattgacagcaattcagacttagattcgctatttaagcaagtttcagacgaaatgaacagtgctaacgcagtaaaagcagtagcaaaaaacatgaaggcctagatgaggacgaaagcgttcaaaagagtagtgaagaaacgtatcacgaaattttgttaaacgcatttgcctatctaggcttttctaatattcgagacattgaacgtatgacacttgttgagtatgagctgcgtatggaagcctatcagctgaagcaagtcgacagacagaacgaaattgcacagcaagcatggatgaaccagcaagtgcaggcaaccaccggtagcaagaatcctaagcctaagttcaagacatttgatgatttctttgataagaaagcagctattgataacgtgcgatcaaattatgagcccaattatgaagtatcacagatgagcaaaaccgagctcaaacaaaagagagcacaagtgttcgcaaaacggatggccgaatttcagcggttgaagcgcgaaggcaaaatcattccgttatctgaaagaaaggagggagcacatggctgacagttttagcgttgaagcaattttatctgccgttgaccgaaatttttcgggtactttcaagaacatcgcgaattctgcgtcaaaggtcggtgatagctttgaaaagtcaacaaaaccagcaggcaactttgtgtcaactgtgagtaagattgctggtgccattggcctaactaaagttgtgggtgccattggtgcaggcgtcaaaagcatggctggtgaacttgacgcttccagcaaggcgtggcaaacgttcgagagcaacatgaagttcctcggcaaaacgcccgcagaaatctcaacgattgaaaagtccttgcagagttacgcacaaaagaccatttacagttcatctgacatggcttctgcctatgcacagtttgcatcagtaggtgtaaaaggagtcggccgccttgttaaaggtatgggcggcctggctgctgccactgatgatccaaagcaagccatgaagacattgatggaacaaggtacacaaatggccgctaagccgatggtacagtgggctgacttccgcctaatgcttgaacagactccagcaggcatggcagccgttgctaaagcaatgggcatgagtacaaaagaactggttgagaatgttcaaaacggcaaaataagcacgcagcagttctttgatggtatcgaaaaggcaggcaacagcaaagctttccagaagatggccacaagttataagactgtcggtgaggcaatggacggccttcaggaaacactagcaaacaagcttcagcctgcttggcaagcaatgtctaaagtcgctgtcggagctattagcggcattattgataagatcggaggcattaacttcgattcagttcttgcttcaattggccgcttcttttcaccgttttcgaccctgatcctgaacatcaggactcagcttagcaacctaggcaagggcgaatcaatgagtggactcagttcgatccttcaagggatcggatccgttcttcataccatctgggacctggtcggcagcttagctaatgttgcatttgtcaatctgattggtattgctcaaaaagtgggtgatgcgtttaattcggtgttcggtggtgggcagctttcgggagttttcgatggtatcaagcaagccgtcactgactttggctatgcagccatgggagccatcacaactgttagtgatattattgctaacttaccgtggaaagcaatttttgaaggtgttaaggcggctttaactggtgttgttaacgtgctgaagccaattgcggcactcgtcaaggcggcatttgcaaatgacattgttaagtcgtttgcggtagcgatcctaggagcagtgggagcctttaaggttattagtttggccgttggaggattgtccagtgtcatcggaatcttttcgaggatgatcggcccaattcgtggtgttatcgctgttgttactaattttggaacaattgcgaaaactgctggcggtatttggaaggctttcggattaatattgggaatgaatccgtgggtacttttgattgctgggattgcagcagtggttgctggtctggtgtattttttcactcaaacaaaaactggtcaaaaactttggtcgggatttgtttcgtggttacaaggagcttggcaaggacttgtaggagttgcgcaaactgtttggaatgctatatcgggtgcgtttacatctgcaattagcggcattcagacagcttggagcggcattacaggtttcttcagcaatctatggactgggattacgaccacggcatcagctacttggacagcattcacaaccacactctcagttatctggcaaggtgctgttaccgcagcaacggcagtttggaacgcgctatccacattcttcacgactctgtggaatggaatagttgcagtagccaccgctgtatggtcaacctttggtggttccctgacgacaatttggaatgggattgtccaagttgctaccggtgtttggaacatgcttaaagcagttattatgggtcccattcttattgtcattgatttgcttactggaaattggacacagttaagtgctgatcttcagcttatctggaacagcattgtttccgccgctggtcagatctggaatggccttgttacgtatttctccggtatttggagccttattcaaacttatgcaatgactgtttggaatactttggtttcagctttagaggggctttggaatggtgcagtatctgccgcttccgctatttggagtgcgctttcgtcattttttagcggattatggaatggtattgtgtctaccaccgagggcgtatggaacggtattgcttcattcttatcaggactatggagcggaacagtcagcacagccgagggaatttggaacgcacttcccggattcttttccggattgtggaatagcattacatcattcttttcatcagcttggagcaacatacagtctattgtgattggagctgctactagtatttttaatggtgctaaggctgtatggtctggttttactggcgtggtaagtggaatagttaatggcatcaaaggagcattcaatgcacttcgtaattttagcctggctgacgctggccgcgctatcatggatagctttttcaaaggcctcaaagcagtttgggggaagatcaccgattttgttggcggaattgcttcttggattcgcaagcataaaggcccaatcagttacgatgccaagctgctcatacctgctggtagcgccatcatgaacggcttgaatgcagggcttactgacaagttctcaaatgtccaaaggaacgtttcgagcatggcacaagctattgctgatagtgctgctgttacgatgccggcagtgaatacttctccctttgatgcatcattgcagtcgctcaataacagcgttcaaggtgcaaccttgtcttcaaatcttgatgtcaactacactcgcaagcaaacgattgaggttcctctgtacattgacggccgagaggttgctcgtgcaaccgcaaacccaatgcaaacagagctcagtcgcatgacacgaatgagcaatcgacgaaaggggatcgtttaattttgtatgattttagagagacaacgccctttacgggttctgatgacaaccagcgcccagcagaggcgatgctaatagatggccagtacattgaagacttgattccgggttatagcacgctgcaagtcagtggccgagaactactaagccagtcaatcgagaaacaaacgattggcaagtcagatggcgagtttatccagtatgttcggaacccttctcgtgagattattgtcggctacaggctttcagcagcggacaatctttcgttccgacaagcattctataagctcaatgacatacttcacggtgacactcatcaggtttcgttcaatgatgacttgtctgtgtactggaatgccgtgctcacagatgttgacgatgttcctaaaggccggaatgcgatcacttcttcatttactttgtttgtccccgatggcattgcccactcggtagccacgcagacgtttgacaatatgccttacaaggatatcccgctgaaccttatggcaggcacaagcgctgacccagtatcagtcacagggtcgggctggaatattcaaaagcttggatcgttcaacaatcctaccgttgggaaaaagtatgcagctacggtcttgcttgggcgggccgattttgctgtcagtttccaactttgggcgaatgatatcaatggcaatcggatatcactggctgggtttcccgtgaccacacaaatgggagcaaatcagcgcagcacgattgtctgcacatggcctgacccggggacgactggagcagctcagattgaggtgacacttgcgtgggccttccaaaaaacggatgttggcacctatcaatatctcaaagccaagttagaggaaggcaccacttactcaacatggtcgcctaacccagctgatcctgaatactattccgacaccattacggtgcacaatggtggcacttatcctgttgagccagttatcacggcaactatgcatgctgataatggggttgttgcttttgtcaatgatcaagggtcagtcttgcaatttggttcgcccagcgagattgatggcgttgtgcggcagaagtctgaacgggtatactattttgactttgaaaatgaacctaatggcattgtgatgaatgatggcgcgctgacttatcccaactatcgcgataatccggctacccccaataaacaaaaaggcattttctcttatggacgcccagacggctatgacaatgcgattgcttaccccaacacggaacgtaatccctctaactattggagcggaccatcaatgagcggaaaacttgctgctaattctaatggcaaacagaatggcaactttgaatggcgtaatctaatccgctttgcaaccatgacaaattgggctggacgagttgaattcaatttgacttacgaaggcaaaatcgttgcttcgttggcactttatgaccaaagcacaacagatgaccaagttatgttcgaaggcaagatacatgacggaaacgatgcgcgaatgctatttcatgaagcgctaccacgtgacctctattcaagggcaaacagtttcgccgtcatttcaaaaatgggtgaccagttaactttccgtattgaccgggttggtggtggcaatgttattcggccattcactattgctgggtttggtgcattgccagttgatggctggacagtatggttctctgctttctcagatgttctcgaagccaatatgggctggcaggacagttattttgattgggtaaacgttgactattggacagacgtacctaaccgattcaaggaaggcgatgtggtcaagattgatgtggctaaacgggttgtcagtctgaatggtgctgaagaccctactttacagactgtcggtaacaactgggaaggcttccagctgctgccaggcaaaaacacgattcaagtcttgcagtctgattgggctaaaccatacacgtgtcaagttgaatggcaggaggcgtggctataatggatttttatttcactgatcgttcttggcacttgctggggatcgccacagctggtgaggggccgattcatattgttaatgatactgatgatcaactgatatcagctggtgcgcgaacgtattcaggcaccattttatttacgccagaaacctcagctaaggtcaaatccatggctgcttatggcaattatgtcttgtacaaagatacgcggggtaaggctgttttcatgaccatcatggaatcaaaccatgatcctttactgggtgagaccactttcactgctgaagatgccggcattgatcttatcaatgaaacggttggtccgtacaaagccgataaaccaatgagtattgctgaatacattaattttttcgtgacagattccggatttgatattggcttgaatgaaattccagacttgaagcgaacacttgaatggactggtgaatcagatacagcactggcgcgaattttgtcggtggcaacgcaatttgaccatgcggaattggagttcagctttcagttgaatggtacctcggtggtacagcgactcatcaacattcacaaacgcattggtgccgataagcggattaccttgtatgttgataaggatatcaacaagattgtaacttctggtaacatctgggatctgtatacagcgattacaccaactggtggcacgccggaagctaaagacggggacacgagcgaacagaagccaattacgttagctggctatcaatggactgatcctgatggtcggtttgtattgacctcagatggcatcttgcttgatccggtagccaaccagcagtggagtcggctattaagcggtggcgcaaggccagatgccgctggcgcctatatcaatcgggtcaacacttatgaagcgaccacgcaggcttcactcttgcagtcagcattgagcgacctaaagaagcacaatcacccagttgtcaactatgaaacggatatagcgcgtctgccggataatgtggatattggtgatacagtgcatttagctgacgaaaatgagcggttatatctatcggcaagattacttgaattgaagtccagttattcaatggatacgcacacggcgactttgggcgattatttgattgagacggatcaagttgccgctcagtaccgtgaactggctgagaaaatcaagaacattcccaaaacagtgcagtattggccttgggtacgttatgccgatgacgacaaaggtaccaatatgtcggcatttccagccaacaagaagtacatggcagtcgtttacagtaacaagtcatctgtaccaagtgacaatccggatgattacgctggcaagtgggcattgattaagggcgctgatggtgctgatggtgttcccggtgcaaagggtgcagatggccgtacaagctattttcacaccgcttgggcagatgatgtaagtggcaaaagtgggttcacggtatccggtggcgatggaaaaaagtatattggcacctatagcgacttcacacaggccgatagcaccaatccagctgattacaactgggcgctttttaaaggtgacaaaggtgatcaaggaccgcaaggtccacagggaccacaaggtccacaaggggttcccggaagcaaggatgtgccttatccatatgtacaattgtcggccccagcaagcccgaaaaaaggcgatacttggtggcacggcacgagttacaatgacgcaactgccttgcagtattatgacggctcaaaatgggtcgatcagagcattcagcaagcagtgttgaatatcaaaaagttgcaatcaattgagattgacagcgcagaaattaattctccaacaataaacgtgcctttcactcatgctcctattgaaggtggacacatattgtcaactggcaagctggctctgaatggcacttcatacaccattgatggcacaattgaagatactaagggtaatccaaatggtcaaagatatcatactgagttaaaccccgatggcttactgtcatatataacacaaactgacggtacaacgaagatggatgttagcagaatctcaatggggactcttgagtttacacacttagctagtggactgggaaacagtgcaacctatatctcaagcactttagacactgtaaaagtcttgcaattagcaaataataaccagatggtttggcagggggctatgatgcccgagaatggagacgttgcgacaatgtcggttccactgtctcaaacactaaccggctggctcattgcttggagttattttcaaaatggcgtgccaacgcataacaactatgccttcactctcataccaaaggctgcactggtatacaacacaactggggctaactatttgcgggtaaccctcacaatgaatgaagttggtacaacctacaaacttttgttttatgacgataggaatattgttggcaatgatgaaaacgcaacaggatatccagctaaagcggttatgactgaggtatacgcagtttaggaggttgctatggaagttgacaaagtaaaagccatttttagcactgatgaagatggctatatcactggctaccagcaggaattttgggacggcactcagtggcaaacgccgtttgatgatgagaaagccatcatgatcgctcctgaagagctgaaaaagattgccattggcgcctcaaagttggctgatgacggtactgttgtcatagataccgataaacaagcagcattagacaaagcggctaatcaagtgacaccgaccgcagaacagaagctactcgcaaatttaactcttgaagtagcacagctgaaggcggcgaaatcaagtgactaattatgatcagtgtgcactactttacagttgggggattgatttaacaccttatgtaccggtaatgatcaccccagatcaatacaaacaaatcacaggcagtaactatgtcgccagcaaaagctagcggctatttttatggaaggaagtgagaaagtgacattttttggatacacgattggtgactgggcagaggttatatcaatcataggggtgggagtaagtgcgggcagctggctgttcaaaaagattgccttagatccattacgctctgatattcaagtgctttcagagacaattaatcgtcagctaaaactgcacgaacaatcgctggcagacttgggacaacacttgaggacacacgatgatgagcttggcagtcactcggttaggattactcgattggaagaccatgtaggcattaaaggagaagataaccatgaagattaattggacagtacgagtattgagcgtcaaattctggctggccgttgtgccagcttctttgttggtggttcaaacggtagcagcagtcttcggttacaactgggactttgctagtttgggtaaagaactcactgcagtggtcaatgcagtatttgcgctgttgaccatcgttggggtagccgttgacccaaccacagagggcgtcagtgatagccagcaggcgttagcttacccggcactcattaccaccaaggcagctaagatcaaggcgctagaggaccagattaaggcgctgcaagcggataaagaggctgaccaggtaactgctgctagtgaagtggttccagagacgtcttctgcagcaccggcggagtcagctccggcatcttttgctccacagcaataaggaggaaaccatgaaactaaaaaccaaactaattaccttggtagtcgccttcttggcggctatttcttttgccttgccatcgcaggccaatgcatcaaagggtgatcagggtgtcgactggagccggtaccaaggggataacggtgtctttggatattctactgacaagttcggcatctctcaaattggtggatacagtggatacggcacgtacgagcaaaccacctacaagacacaggttgcatcgttgattgcggctggtaagcgggcacacacctatatctggtggcagaatatcgacaacaccaatttggccaagcaagtactagatcatttcttgcctgagattcaaacaccaaaagggtcgattgttgcgcttgactatgaggccggatcaaccaacacggcaaccttgctgtgggcactcgactatatccgcgatgctgggtacacgccaatgctctacggttataagagcttcttggttaaccacatcaacttgtcacagattgccagccgctatcagttatggctcgcggaatatcctgattacaatgtcactaccgtaccgaattacaattatttcccgagttttgacaatgtaggtatcttccagttcacttcaacttatcgcgctggcggccttgatggtaacgttgatctaactggcatcactgattcaggctacaacggtagcacgacaacgggtagtgggaaaacttatgttaagcctgctacgagcacaccagcgacaaaagcaggccagcaagccaacaacaccacacttagccagatcaaagctggcgataatgttaaggttaacttcggcacaacccgttgggctaatggtgtcgcaatgcctagctgggttcagggcaagacgtacactgttcagcaagtatctggatctaacgtattgcttggtggcatcatgagctggatcaatcgtagcaatgttgagctgttgacaacgaccagcgtgccgtcagtaagctatggctctacctacacggttcagtctggtgacagttggtggtcgattgcttacaaatatggcatgagcatgtatactttggcttctaacaacggtaagtcaatctacagtgtgattcacccaggcgatgtattgcgtgtctctggtggctattcagtggccgtatcaagtcacacgtactacacggttcgatatggtgacagcttctggagcattgccagcaagtatggcattagcatgtacacgttagccgctaacaacggcaaatcaatctatagcctgatttatccgggcgaaagcctgtatatcaggtaacaaaaaggccctctgctcgctaacgcgggtgaagtgcttttttacttatgcaataatataaatataagtaattggtggtgaagttgtggtgaagtgaatccgaaattgtgaaacctaagaaattgatatagagctatttttgcttttacaccggcgatttgaaaccctatgaaatcagtgctcaagcaaatcacaacaagaagaacatgttcgcactgcttggtcgtccgggttatgaggatatgactaaggaattgaacgcacgcctttaatcgcaagggtttgtgcgatttgaaataaggtaaataaagagctccagaatcatgttggaaacgtccgtggctgaattttggctgtcagtcaggagttatcaactggttctggggctttttttatgggcatgtgttcgggcagcgtttgaatttgttgctccacaagagttgaagcagcgttaaaaactaaactaatgctagtaattgcttttgactccagggttttagctcagttccatactgacgcgctaaattacgtgccttttcggggagagcattttcaacgtcattatagataatcaggtatctaattttcatttttccttatctatattgattaggattgattacgccgaatagtccatacgaataatttcaagcggcgcatctaagaaggaatcaatcccagccaaaaactgcttgaagtgggaggtttcgttatgtgccgccacggcctccgcatcctgccagtgttcgatgatctcgtatttatcgggatcagtgaggctttggaagtggtcatagctgaggttaccggcttcagcacgcgatcccgcaaccaattgactgatgaactgctggtagtcgctggcaagctctggtttgacgtgtagggtaacattaataattttcattttcttcctcctaaaggggttatggccacgagggcgtaatgtattgatagaggcgttcttagaaggtgaacttttgccgctaagatcgtcactacaactgattatactagcaaataaatgggcagcaatcgaaatggggtggggccataacttgtgatgagcttatttcagccggaatgggtcacaagattgggtaaacttgattaaggatttcacgagatcggttccggtgtgagcgcaaaaaagccgttgagcagacagttgatcaacgacttttttctctgggcagaaatatttaatttttggtgcttgttccgtcggcgtaattgatggtgtatcctggttcgacattaaaaatatagacattgaaatgaatggtgttgtcgccgatgctttgagctcgcatttgaacaccgcgtgcaacgagttcgttaccgcggaaaattggctttacctcgtaacggacgtagtggtcattactttgtttgagataataagcgatatccatttcatgagccaacatcaagggactattgagcgtttgagtaccggtcatgagattctttgggttattattttcaccggtcagttggtacccgattaaatggctacgattatataaccatccatgtgccgtttttttattgtgccagccggttgggttccaagttagtggttcgcgtttggctgaaggcatgagtgagcggtttaacaaggcattggcatcggtcacccggttgagactatctaaatcggaataagcggcccatgcgccttttgcagttgaaagatcattttttgaaaatgcgggatcgttgttattgacggttatttcttgctggccggtataatcgagattggctaaagtattggcatccgtggtacctgctgtcgtttttgaagcttctgtgcttggcttgctgttatctaatgtcgcttttagactgctaacttcttcacgtttatcagcaatagcttcatcgagactgctgatcgcagaattagtcttattattaagtttagtctgatcggccacaggatccgtggatggtgaggttgattttgaggtgccttgagtactgcaaccggttagtaagagacttactatgagcacgggggtaagatatttcattaactttgttttcattagcgtaatgcctttcgataaccagccgatgatgcctcggcttcggtatggaagtagacagcatttgcagcgttcatatggtagccggcttgaccaggaacgtgatagatcttgctacggctgttgccaacgatggttccttgcgtgccagtatataaatcaccttggtttgttggcgtttgctgctgtgccggcgcagcttgctgttgtgctgccgatttctgggcttcttctgcttgtttggctgcggctgcatttgccgctgcttgcgatgaggcagccgcttggatggatgccgcagctgctttactggcagattcagcctgagatgctgatgtggatgcagcaagagatgaggaagctgctgccgctcgcgatgaggatgctcgttcgtctgcggctgcttcgagtttcgtttgttctttggttaaggcttttaactccgcgttttttttagcttttactgccaataagacttttccgtgtgttctttcggtgttcagcagttttcgctgttttgtcgttaaccttttattaacaacgcttgattgcgaagttgaacctgtcgatgtttttgtgtcactcatcggggtgccaatgaacattaaaataataccgccaattagtagaattaggttgagtcgtttcgttgacggatgtttccgttgccgaaataagcgcacggcaccccagatagtcccacccaatccgagtaagattaaaaagtcgcccaatgtagccatttttctcctccaatattcctaggttcgaactaggaataatctcgaataagaatattcgtaatcccttatttacaaggtttattttcccagaaaaaaagcttggcggcaagcgtcaagctcgatttgaattaggacttcaccacgtcaacatcggcatatagactggcgatgatcgcaagcatatctttttcggttcgttcccagctgattgtttttagataggcttgtgctttttcgatattttgggtaatgatctcaggtttttcgcatgctgtttggagtgttttggccagatcacgttcatccaagtgacatgaaaaataagtgccatccttcaggaagtagctgccagtgccttccttaaaatcgatcagaggtaggccggcgctcatcatttcgtaagggaccaaagagaaattggtcattgaaggggcaataccaaaatctgcttcatggtaaagctgattgagttctgccggggtcagctttccgagattctgaccgttaataaagcgtttgctgcgacccgtaccaaagtaagttattttgagatcaattcccttggctcgtagcaaatggcgacagttttcaaggacaatttgaatagtgacaggcgcgcggcgaggactgctccatttggtgtaaaccgccagcttgatttgctttttatcttggtaaggcttgggatcgcgttctttaaacgggtaacgtgccacatcgaccgggaaattgataatgtcaatcggactgttagttttgcaatgtgtcgtaatcatatgtgcgcaccaaggccctagtgaaaccatgtgcagtccgaggctataagtacggcgcgccatctggtaacgatcaccgtatgggtagaaataaggttcataatcctggacaaaatacatcttataacccggcttatttttgatgacataaacggattcccataaagtagcgacccagatgtcagaacggtgcgattcgagttctcccattggcaaacaagttcctttatagcctggatagttaaattcggcgttttgaatcatctcatcttgactttgcggaacgtaacttagatagtaaacgtcataacccgcattggctaacaaggttcctaaatgcagcatggttgtttgaccaccatcaaagccgatgataccggtcgttacaaaagtgatccgattgccgcgcggtttggtttgatcggcaggccgatcgttgaagtatttaagtatctgatcatattgatgaatactaccatcaggagcgtcactaaatttagtttttgcaggtttcacagccattcctcctcaaaatttttcgaacgatgaagtgcaggcaaagactcgaaaattaggcagaaaaaagaagtctggtgtcacggctgcttgtcagcggcgatacccgattaaactaaaagacgatgcaaatgcctgacgcttattttagtttacataataaccgtaagctaaatagtgatcgttttcaagttcgccaaggttggaacggcgtattctgaatgatagagagggttttgccataatattatgaaggtttgttttgaaatattgccattggactgaaattctttttgtaactggccattgtgctcgtgaagttcgaggacctggttggccagtgaaatttcagctttcctaagcgcctgttcaaatcataatgaatgcttatctttaccgtgagatggggctgtgctagtgtgaaagtatcgatatcaatgaaagaacaggtgaagctatgttaacgattggagtcattggtttaggcacgattgctcaaaaagcatacttgccagtttacgcgcaaatgcaaaatcaagtgcactggttattgaatacacgcaatgaagacaagttagaacagctttcagcacagtatggacttgaaagtgcaggccattcgctacaagacctcgatggacagccacttgatgcggtgatgattcatacaccaaccgcaactcattatcagtatgttaagcattttttggaaaaaggtgttcatgtctttgtggataagcctttagcaaccgatatggcgcaagttaatgaattatatgatttggcagattcgaaacatgtcatgctgacggttggctttaatcgccggtttgccccaatgattcaagatttagcgcaagtgacagataaaacaggcgtccgcgttgataagaatcgcattgatgcgcttgatgataccgaacatgcactgtgggatcttttcattcatccggtagacactgcactgatgctcgctggctatccggaaaaaccaaacacccgctatgccttgcacaccacaagtgatggccaacttcaacaagcaagtgtgacgttcacggctccaggtattcgcggtgaggcagggattgacttacaagcaggcactaaccttgaagaggcacaagtggcagctccaagcggcgttcaacgcgtccaaaacctggatcaactggtcgtgtatggccgtggtggcgcttcacaaacctttgccccagattggcagcctatgcttgaaacccggggatttgcgccaatggtacaggcatttgtccaggccgtgggtaatccagatggccagaatccggtatcaccggcaaccagtcaattagcgcatgctgttgtcgccgatttggtcaatcaaattaacaactagacagggtactaacccaaaacgcttttgaagatcgataaaatgaaatctgccagcttggacatgagtgtcggacaagcagataaggaaggggacaagtgctatgtatcaaaaatcatttatggcaatggctgatgaagaagcaaaagcaaatgttaacggatccgatggcgggccattcgggtgcgtaattgtcaagaacggtcaagtcgtcagtcgtgcacataatcgggtgttggttgatcatgacccaactgcacacggcgaaattaccgcaattcgcaaagctggccaggcattgggaacacacgacttgtccggttgtgagctctatacttcggcgatgccttgcccaatgtgtttaagtgcgattatttgggcaaatatcaaacaagtctattatggcaataccgctgatgatgctgcggcaattgggtttcgcgatgctgcaatttatgactttatcaatgccggattaaagggggaaatgctgaagctgagtcagcatgatcgcaatctgaccatcggcgcgtttaaggcgtatcagtcagcacaaaaggaattgtattgataagttgacacacatttctgcagctggtggcttggtggaaaagggtgcgaagtggtcgcttactcgcaaaatatgtttgacatttttatagattcctgtagaataatttaggtacgataaagcgccactcattgcccgttggtcaaggggttaagacgccgcgttctcagcgcggaaacacgggttcgaatcccgtacgggtgagaaatagaataaatgtgatgaaacgaaatcctcggaatgcctttataacggtgtttcgggggtttttgttttggagagaaaagatttgaatacttgagattcaagttcaccgtcaaaagtaggaagtcttgtggcacaaatgctttggcgtttgataaatctaggctgattgttcgatattcatcattgatgtctgtacccctttgagtggcaaagactttgacgtttgatgaattacgttggatccattttgacaaccttgtgggatactttgccaaggtaattttgtccaatcgtgtctcaacagactattgaagaatcctcaaattaaattggctggggaacggttagcacaaaactgatgaatgcgcttctgctcgctgatgctggatgaaggtttatttttgtggcttttgggaatttaaagatgtttcttttgcgagagtgactttatggtgaatagattgattttaggcgaacggaaaaattgactcaactgcggtgattaggcattatagataggatataaagtataatcgttcagcaaagaagatcccaagtgagttctaacttgatagattgattgatttttatatggcaaacgctgctagccggaacttagctatgttacgagcgccgacgcgggtgatgaagatatttgaattttcgatggaagaagatggatttgatgagtagtaagaagttgaaggatattcaaaaggacgtaccaattcctgtaggtatcgttgatgaacgaccgattcatccagcccgaaagctctcagaagaagaatctgttcaaattatcgctgattttgagcaaatttcgcttgaaaaagtttttaagcgattatcagaaatacgaagggaaattcaaaaagatatgaaacgataataactgtgaagaccgccagtgtttcggctatttttatgcccctttccctgcttgtaggccaaaagaacaactgagaaatcgtctcatacaactttaaatgttggtggggcattcgatatggataatgattctattcatccgtatattgggaaaagattaaagaaatacggagaagtcctcttgcacggtacttcccaaagaacttgaatcggcattccggctcacatatgatctcagtaagaactatgcatccatgatcctaggcttgttagcttgtgagtagaatgagggaaggggggtgtggacttctaagttaaagtcaattcactaaatagagagtcagcactattttgggatggttttttaaagggagatgattctgaggtcgtggcactttactcacagttaatgcgattgcatattcctcaggtagtcactcttcccgatggcgttgactattatgacgaaatacacaccggacccaacgtctataaagcaattatgaagatctttcctgataatgagattttaaaagctccgtcagatgactatatgggcaacaagaaattgcgcgtcttctaatacaggaatttaaataaaatagttttatatgaaatacattcatataagataggcagcctcaagggagtgactaaaagcttggcgttgtgtgtacgcatgacatcaaggcttttaattacatagttgaccaaccagtggagtatacaaatgattaacaaagttatagatgcttctgttgctgaagcacggcacgcaaagtatactgacagtgtagttgatgttgtttatgttagcgaatgtaccctataaagggagggatagattaaaatgagaagagattttgttaaaaagtcttttgactattacatgtctcatccagcgaaagttgatctgccattacgaccacaagatattgttccgtggaagcttgatttttccgaagaagaatggcaatatttttggaaattgcttaaagaatgggacgaccaattaactgaatggcccgagacaacacttggatgaaaacacaacctagtcgccatgcgcggcaatttttatacacttaactaaagagtgaaagcacaacaatggccctgattgccgctgcgtcagagtgtatccacaaaatcatattcaatcctatctatgccgcgctgccgaagagatccgcaagagtcttcggcagtttttgcatgaattcactcatgatctgattaatgaccgattgagcttcatgataagttgacgctataccaattaattgtgccatgagccaactcaaagctcgcgcaatgccggtatcaggtagagcttttccatagtagaagaaaaagtcacccagcgtgcgttcctcagtttgtccactttgacacaaggcgagcagatcatagctcatcatgaccattgccatatgtgcgcataaaccgtcataaccacgtacttgcgtcgcatcaaagcgcagatattgtttagcgaccttgaagtagccttcgatttgccagcgtctgccgtacatctgaatgatgcgttcggggcgcaaattagtttttgtggttgctaaaaccaagaagcgacccttggcaccttttttagtcacgaaaaccagtttcatggccatctttgtaccatccatatcgtattgcacaatgggactgtacagataatgctgatgtattagccgtttactctgctttaacgtggcatagagccgcttaacatccatttctcgtccccgataacgaaagtacactttctctgtctgcttgatcatgccgatgccagtgatcccgcgcttaagcagttcatggaacatcttgggataagcaaaccagctatcaaataaagcataatgcaccttgacgcctgctttaatcgcttggtcaacgagttcaagtgccaccaagttcattttgcgatgggcttgctggcgacgtttggccgcaagtgagcgtccatcatacggcttttgcgggccaacctggttctttgtcttacttgaggccatcagcgcaaaggtgagcggcagaaaggtattgccatcactccaacctagtgtcaaagcccgaaagccggtatagtaccgttcatggtcatggtcgaatactttggaaagtaattcggtcttcttggagaactcgcgcgtaaatagtgaatcgtcaatgacgaaggcttgatcacggccagtcgcggcaaactgatggagatattgaatcagatgaaccgctaccagcaaaaccagccgctgccaattgatccgagcatcatccaagcaattacgtgctgtccgttttgaaaagtcgggatcggcttcagctcgatgcagtgagtaacgttgaaagatggaccaatttaaagaaatgcgttgttttgagctgaatatcatgggttgattgttgtatagtaaacatggacgtaaagactcccttgtatgttggttttggtcgacttaattatacgacgcggagtgctttgcgtcttttttaataccaaaaagtcccgatttctcgggactttctgcggatattcaactttcactctttagatgacgtacttacatgaaagagaacatgttcgacagtacaaaaattacggggtaaaatttggtcagggtcatatgacgcgcttttgaagaagagccgaacaggcaggccaaaaatggatgaagaaacgcagaaaaggggttgaaaacggatgacggaattcaaggactacatcattggaatattgaagaatcagcgagaagagccaaatggcaagtttggatatcaattcatgcggatcaccccttacacagtgattttgtttgcttgagacaatacagccaagcagaaaactcaaattgaaatacgttcgaaagaaaaaaagcctaatgaagtagcttgggaaaacctttatcctgagtatgagtgggttaacgtttaacaataaagacgaacaagtaataggttagccgccagtgaacggctaattttatggcattatgaattgtgaaatggcgcattttattacagatagattgttactatcgcgatatagtcagacaaagatactgcaactaatgacaatgtggtcaaaaagttaaactgagtcacaaattaacgaaccagcacgcgcttgatgatggagtggttgaggcgttcaagcgagccaacatagaatacacacaaatgtacgttgaaaagtacgttatagtaggtgtgctatgaagatgtctggagaagcttaagcagatgccaagatgaacgccgatcctgataatatcattatgagattcgtcaaaaaaatcacgcgaagggagctgagcagtcttggtcattcctccaattagtatcattaaatatgttaagttcgaaagcggtttgcccgtgctcacaattaagcatccgacagctcggcagcaagcagactttgatcaatataagcgagccgaggtagctgaagaagcttacaaagaattacagctctcgaaggtaaagagtcgcactgaaagataagtgtccaactgcctttgaggggctatttttgtgttctttttttctgattgtaggactaaaaaacaactgaggcttctctccaatgacgttaaatgagagtaaaactattcagctggataatgagccaaagaaaaatccaaccacaaactaaagatgatccagagtatttaaaatttcgcatgcctatccaagattgcctacattctcacttgacaaccgttttaacatagaaggtgtaggcgttcctttaacattttaaaggagccttttgatataaaaatggaggcgacggcatcatgcaatatcgaattcaactcgataccaaaaaccagttgtttgtggcgattgatgcgcatgaccagaatcattttggaactggccggacaattgaacaagccattcatcaattaaaagcgacaaataaagccgcgtaataaaaccccatctgctactggcgtaaattttattgctagttgcagatggggtatttttaattggaagagaaaaagatggattactgataacgtatcaggtcgcggcgggttttgagccagatagcagtgagaatggcaacaagtgctaagacgccgattgcagcgatgatgaagaggctgcgatagttgaaccaatcgataacaaggccgccaaataacggacccagtgcacgtcccactgatccccacgaattaacgaagccttgatatcgccccttaatcgcccgtggcgttaagtcattgactagagcgggaatagcaggggatgcggtggcttcacccgtggttaaggcaatcatggcgatgacgaagaaggggtaagttcgggcggtgatgaggattagaaaagaaattgccaccatcacgaggccaaacaggatttgatagataatgcggatgccgttgacgtgttcgttaaaccagtttaggaatagctgaataaccacaattaaagctgcgttgagcgtccacaagaagctatagttgcgtagtggaatgcctagtcctgtcatataaactgacaagttagatgaccattgctggtacatgagccaaaagaccagtaaggcaaaaaagaaagttgttaacattaggtgatttgctgccggtaatgtggcttttggggatgctgccgtcgcttcttttgaaggtgtacgtgcgattttggatgctggctgaaattttgcacgacaataaaaaatagcacatacaagatgacggcaattaaaaatagcagggtgatgctgatgtcatagataaaaccaactaaagaggtgccgacaacaacaccgacgttttgcgcgaaatagagcatggtgaagacgtatcgaccatcttttgaacgtagactggtgccgagagaattaaccatggtaatgttccaaccggagccgataccaagtagtgccagccaaaaacagtaagccggccatccatgccaaattgtcaggccaattaaaacgatgccggtgaggccgacgccaaataacgttagccgaaaaggatcgctttggtcatacagccggccgccgacaatactgccgataacgctgccaagtgagttgagtaataaaacgacaccgataaccgttagagagatatgaagccgattatgtaaataaatactggttagtggccagataaaactcatgccgatactactcagtaaagcaccagttagaagccagcgcagtctgatttcgcgttgcatgacaacaccatcctttgtatgtcaacatatttgggggatcgggttttgaagcaccgaaccaagacttgaatcgtgatcatggtgttctagctgtgtcaaactagttaagtcagcgctgggtatgaatcaacccatctgcttgtcactaataaatgttccgtcccaatataataaggccatcgtacgtcaagcatgagtagtaggtcaaacctatttttatagccgtgaccgctgactttttcgggtgggcacggatcggagcgatcaaaacctgcctgcattaaagccagcatgctgaatttgtttacgttgaaaagcttatgacgttgctggcacccacatgcgcagataagtgatgaagtgaaggacaatgtcaagtaacagtaaaaccccagcaaaaaagcggccctcattttgaccgcttgcttgctattaaaggttcttatccatgttgaaggttagttttgaaagtttcaagctttccatgacgtattcgttgatcaaggctttcgttgccgctttggtatgcgcgacaatcttgtaattggcgtctgtcagatattgcgttaattctttggcgccaagttctttggctcctttgtcaaagccttggatcatttcgcgatagtcgcggttcaaggcggttagatagtcacgatccgcttgaatgaactgggtgtaatgtgcctctaccaatacatcaagcaatcgatgcagccagtaagccgaatcagcatcgatatcaaaggttttcggtgttttggaatagctcgggtcggtgtcattcgcgttgcaataaaacgggacatacgggctaaatgaaggcatgccgattgccagccacataatggcttccaaaccttcctgaacatcactgcgcaactgcaggatgtgggaattctgggttcggtttaaaccaatcggccgataacggaagcggtcggcatcatcaccgtggccataaggatcaaaaggtgtttcgttatagtggctgccaagaatctgggcaatatcttcgcgggtgatgagatgatcggtccgcatgataaaaggcaattccgcagattccggatcggcttcaatttcgggattgagcagtttatgaccgtaccaaacgcgtggggtgttgtaatgacggtctttttcattcatcgtgccgaaaatgtggcggaaattccagccttctttgtcggtgttgaggtgatgggtttcgacaaattcctgaataccttcgctccaagcaaaattgtcggtgtcgtcaaaatcgacttgttgaatcgcaacctgattggccgcaatcgcataagcatcatcagggatacgttgggcaacccagtgatggccggtgacgatttccatataccaaacgctatctttgtcggaaaagagcaccgagttaccggctggcgaaccatattgtttgatgagctggccaaggtattcaacgccatgacgagccgattcaatgaaaggcagtaccatattaacaatcaagtcttcatccagaccgtctttgacaagcggatcaaaacccaatgcccgttcattgccataagtgctttccgttgccgacattgcaacgttacgttcattaatgccgctttcttcgtagtcgccaagtttatcgttttcaacgtttggaacagcgttgtagcgataaccattttcaggcaaatccgcctcgaagccattcagcggtgacttgacgtgcaaggatttctcgcctttccatccggcgtgcatatagaaccgttgcggcgtcaggggactaaacgtgtcatcgttacgagcgatcatcgttgaaccgtcaatactggcctttttaccaaccagaatcgaagtacatgcagattcaattttcattcttgcgcctcacttcttaagtattggtaatagtttacgccagaattaacttttttgcaccttcatcaaaaaagtcgttgacaagtgcgcgatttttttttaagatattactcgttgttaagttactgggtagtagcgaagtggtaacgcagtggactctgaatccataatcataggttcgatccctatctacccaagcagttcacagtgaccgcgattcacaagcgcttatgaagccttgtgggtcgcggtttttagttgtttttcagagctactggtgtttttaaaaaagcatcaaaatatcaccatatagcaccacaaagaataggcaaacctataatatagctggtctgccttttttatttttatgatcccaaaagtttcacacacgctgcacccaagccaaaaacccagcataagcaaagcacccgcacgtatagatcaagaaagcagcgataatgaacgccaaccacggccaggttaaaaaggcgcgggcgatgaataagaagaaagccatcaataccgcacgtaatccgcgggttaagacggctttgacagtgctattcaaaagaaacctcaatgagtaactgcttggccttggtcaaatggctggtcgtgagccacatctgatcagaggaaggggcttcaacatcttcacctaaatcaggcaacaagcttagcaaccaagcactaatgtcaggattgtcaaaagaaaagtgctctggtagtcgaataacccgcagccgattcggtggaaagaaaatttgttgttgcgggaaaataacttggtcgtcaagtaaaatactagcaacattttgatacggtacctgacgaacctgataactttgcggatggtcatgcgcatatgccagaatcataatggctgcgtcaatcacaaaaagacctccattcaaatcaaaattatttacgaaattcatgataacataatagagagcgtgagcgggcccggttagaagtcggagtgtaagtggcctcagccgtgatggccggtctttgaccattgcgacaaaggtccttacacgtagattcctgcgccggggaacgcgtttaggaaaagagcggtaaccgccgcgtccaaggctcttacacgcgtcccagtgaccaagttataagtttacgctaagttgataagtccaccagcacagatatataggagcggttaaaagcatgacaaaacgattgtatttagtcagacatggtgagacgccgatgaatgttgctcgtcagctgcaggggattaccgacgcaaacttgacagcaaaagggcgtgatgctgcagatcggttgggtgaattgttgcggccgataccatttgtcaaggctttttcaagcgatcgcgaacgggcgattgaaacggctaggcgaattattgcgggtcatcaaccgcaaccggcgttaatcaagttatcggctttacgtgaatattattttggcggactggaaggcgatcctggcaatgctgtgatgacgcggacaattcgccgctatggcttgacggcatcatggcgcgcgtgggtgggttcacagcgttttgccgggttgatccgatccattcgcaatgccgatccgacccatcaggctgaagacttgccggatctgctagcgcgagttcgccaagcgtttgcgcagattgatgctcaaagtcctgataacagagacattttggtggtgtcgcatggcttattattgagtgccttaatctatcagttggcaccggaacagttaccgctggggttgttaaaaaataccagcgtgacacgagtagatgtgactgacaaggggatgcgcctgcgtggagtcaatttgattcgcgaatcagacatcttggcgttgcgccatgatgagcctcaaaaggacgatcatcagaatgaacctcaaagtattgaccaaggtaaagagtaatcaatgttagaagaacttcgttagttagagaagctattgaaaccaacctcaaaaacagttgcaagcggtaaattcagaccattgactgaatttgccgtttttgagttagtgtagaatttctatcggtaaggcgataggtccaaataatagagccatgaggaggagtttaaaaagaggcccgcttcgctaattaagttaccaacaagagtagaggagcaagtgaccttcatggaacaagtactatcaggaatcatgccaaagttaacgggaaaatcatctctatagatccaagaaaaagttgatacttctattttttgattgcattttgtggcatgggcgtctataatgacaccttgtcatatgacgggatgtcataatgaaacactttccaaattgacgaatagatgaagactaggaaggaggtcgccatgccgaaagcaactttttttcgattgccaaaagctaagcaacagcgattaatggatgcggcttatcaagagtttgcgcgggcaccatttaatgaagctagcattagtaatattattaagcaagccggtattccgcgtggcagctattatcagtatttcgatgataaggcggatctttatttttatttgctggaaaatgtccgacagcggacggtggcattcttacaacaagtgatgaccaaacatcatggcgatttgtttgcggcgatgtcagaattttttgacaaagtgatcacagcgctcactcatggcccacatgctgcattgtatcggaatgtttttttgcacatggatattcggagtgccaccaaaatggcaaagtcggatgtgccattttccaagccaccgcacgggcatggtgaaattcatgcgtttttgttaaccagcattgatcgcagtcgcctccggattcaaacggatgatgagattagtttgctgattcgccagattgtcggcatgttcatgcagacaatcggttattactattcgcaccaggctgaaggtaagccgattacggtcgccgaattaaaacggcgtagtcatcagctccttgactggttgcaatttggtgttgccagtgatcgtcagcagcgttagcaacgcatcacactggactatacgcggggtccaaagcaactgttaggaggaaattatgcttaagcttgcaaaaaagcgaatgtcaggactggccgtcattggcgccatattatttatgattgttcaggtcatgagtaatctgtacttgccgaatttaacggccgatattgttaataacggggttgccaaaggtgatattgactatatttgggcaaccgggatgaaaatgattctttttgccttgctcagtattctggcgagcgtaggaaatgtctttcttgcatcgcgcacatcacaaaagttaggtcaaaaattacggtcagatgtttatcgtaaagtcatcaactattcgcatgacgaaatggataaagtcgggaccagttcgctgattacccgaacgaccaacgatgtcacgcagattcaaaatgtttggatgatgattttgcggatgatgatcatggcaccgattatgttgatcggcgcaagttttctggcgtatcaaaagagtcatacattgacgatggtgtttttgattagcttgccattattggccctttttctagtcatcattatgtattttgctgtcccgctgtttaaggcgatgcaaaaaaagactgataatattaatctggttttccgtgaaggcttaaccggtgtgcgggtcattcgggcgtttcggcaagatgattttgaacagaatcggttcgaaggagtcaatcaggattacacccaaaatgcggtcaaggtcttctcaattattgccgctgttttcccggtcatgaccttgattatgagtggtaccaatatcggtatcacttggtggggcggccatttaattgctcaacaggcgcttgaaaccgggaacttgatcgcgtttatgacttacgcgatgcagattctgatgagtttcatgatgctttccatgatcttcgtgttcattccgcgtgctcaggcatcagcggcacgtttgaatgatgttctggcacaacaaagtcggatcaccacaccagaagcgcctaaagcattagataccgctcatccggcattggcatttgaccatgttcagttccgttatcaccatgccgaagaaccggccttgcgtgacattgatgttcaggtaaaaggcggacagaccttagccatcattggtggtaccgggagtggtaaaacgacgatggtcaacctcattccgcgcttttatgacgtggaaaaaggggccgtacgcgtcgatggtgaagacgttaaagcagttgatttaaaaaaactgcatgaagctgttgcgtttgtaccgcaaaaagcgaacctcttcaccggaagtgttcgcgataacatgaaatatgggaatgaaaacgcgactgatgatgacatctggcatgccctagaaattgcccaggcccgcgattttattgaagctaacccagaaggtcttgattatcaggttgaacaaggcggcggcaatttctctggtggacaacggcagcgactagccatcgctcgcgcattggtaaaggacgcctcgatttatgtctttgatgactcgttttcggcgttggatttcaaaaccgatgcgaatctgcgtgcagctttgaaagccgatgccaagattcagaccaaggtggttgtgattgttggtcagcgggtttcgacagttgcagatgctgatacgattgtcgtgctagacgaaggtaagatggttggtaaaggtacgcatgccgagttgaaagccaacaatccaacgtatcaggagattatcaagtcacagattcgggaaggagacgagcaataatggcagacaatcacaaagcccaaacgaccaagcagccatctggcccacggatgggtcctggccgtggtggtctcgttgaaaaaccgaagaacttctggggcacaacagcgcggttatttggttacatgcgcaaccgtctgattggtattattgcggtgctagtcttggccattgcttcgaccgtctttcaaattcgcacaccaaaaatcttgggggaagctacaaccgagatttttaaaggggttatgaaaggccaagcggagcaaaaggccggtatcgctgttggcaactatccaattgattttgataagatcaaacagattattttaatcgtcttggttctgtatttgggtagtgcactgtttagtttcttgcagcagttcatcatgactcggatctcgcagaatacggtttaccagttgcgtaaagatctcaagcacaagatgaagactgtgccgatcaagtattatgacacgcatagtaatggcgatattatgtcacgggcgattaacgatatggataacatcgcctcgacactgcaacaaagtctgacgcagatggtgaccagtgcagttatgttcgtgggaaccatttggatgatgcttacgatttcctggaagttaacgctgattgcgctggtaacgattccgctgggcttaattgttgtcgggattgtcgcgccaaaatcgcaacggttctttgccgcccagcaaaaagctttaggtctcttgaataatcaagttgaagaaacttatggcggtcaggtgattattaagagttttaaccgcgaagatgatgaagtagaggcgtttgaaggccagaatcaggcattttatgatgcagcgtggaaagcacagtttgtttccgggatcatcatgccgcttatgattttcctaaacaacattggttacgtgtttgttgcgattatgggtggcattgaagtttctaatggcacgatcacccttgggaatgttcaggccttccttcaatatatgcagcaattttcccagccgatttcccagcttgctaacttggccaatacgattcaatccactattgccagtgccgagcggatctttgcggtgttggatgaagaagacatgcaggatgagccgtctggtgtgccggcagtggccaatgatcctaacaaactggtcatggatcatgttcagtttggttataccccggatgccttgttgctcaaggactataacctgcaagtcaaaccaggtgagatggtcgcgattgtcgggccgaccggtgcggggaaaacaacgatcatcaacctgctagagcgtttttatgatattagcggcggatcgattcgcttgaatggtaccgatacccgcgatatgaagcgagaggatgttcgcgcgcattttgcgatggtgcttcaggatacttggctgtttaccggcacgatttgggataacttgaaatatggccgcgaagacgcaactgacgacgaagtattggccgcggccaaagcagcccatgtcgacaactttgtgcggcagttaccggatggctacaacacgattctgaacgaagaagcctcaaacatttcgcaaggtcagcgacagttgttgacgatcgctcgagccttcgtggcagatccggaaattcttattctggacgaggctaccagctcggtcgatacgcggacggaaattcatattcagcacgctatgaaccgtttgctgactgatcgtacgagcttcgtggtcgcccaccggctgtcgacgattcgggatgccgacaagattatcgtgatgaatcacggctcaattgttgaaaccgggaatcatgacgaactaatggctaaaaacggcttttatgctgatttgtacaacagtcagttcagtggcaatgtcgcgatttaagttagtttgcaatgatgctgagacctagacaaatattgcgttgcagggaaaatgtttttattctgtgacatgaaaaagggtcctgaagacaagaacgatcttgtcttcgggacccttttagcgttaccgccgcttgtgccgcataaacgttgcgtagtgtagcaaacaagcaagtaagacgaaaaagatgacaacaaagctgacatagcgccaccagaagttggttgccacacctggtatgagttgctggatacccatggttgccaaagccattaccgcgatcatgccgaacaacaataagtaacgtttcaaagtctcatcatccttctttttaaaagtggccaattttgccccgagcgcttgtgcttgtttgaccttggccgctggtaaagccgtcatgccccaagtatgcgggagaaccagttcagtaattttatgtaaaccggcagcggtcatggctttgtcgatggtgacaagggtcgcatcggtctggtgcgtaaacgtgttgtccagaccggtggcaaaacaactggtgacgctaacgtaatgtttatctttaaactttcccggaagcgtatccccttgatgcgtcatccgagtgatgcgatggcgtaaacaatcgagtaactgcttaaactgtccagccacggttccaaagtaggtgggtgttccaagaatccacacatcagccgcgtgcaacttttcctcgagttcgtctagcacggggttggtctgaccggggcgatcaggtcgcagttggtactgatttaagtcaataaactcggttgttgccggcgccgtaacaccggcaagaattgttttaactaggctagccgtcaacccatcaggatcctgcccgccgtaaatacctaaaattttcatttgaaagcctcacaaatcaaaataaacgacttaagtaacaacctgccaaaaataacaatttttgcaagtattacttcctcttaactttaaaaaagattaagaatttttgcaaaccgatccttgtactcatgcgcatcaagctttttattggcaaaaaagatgaagactcattatgctgttggcagcaacaaaaggttaaaggcgttaggatctcatggatgaatgagaaggagagggtcaacatggcaggaattccattgccggaagaaacacgcgtggattttattgcgcttaaagtggctgacttggccaaggtgagtcgctggtatcaagacgttgcgcggttggatttattgcggcaaaacggcagtacggtttatctgggtacgcggttaaatcagcaggtgttagtcgtgttgcatgagattagcggattaacccctcaagaagcggtcaccggactggattattttgccattttattaccgaatccgggggctttaggggcggcgtatcgcattgttaagcaggatcaggcagtgaccaaggcatttcagacaaattatcggcaaggctttttggcgcatgatccggaaggtaatggcgtggcctttacaattgatcgtgcaattgaacagtatcaagaggagcgtcaatacaattgggatgatgaagtggaacaggcgcttgatcccgaagaaattggcaagcatgcggtgcgcgattatgaccgcctgccatcagggacggcgatcggctacgttcagtttcgagtggctgatttacaaacgaccagtcattatttggagcaaggacttgggtttcgcgaaaaggcaacacaggtaaaagatgagatctttcttgctgcaggcgactatcgccatcacattgggattaatttacgccgggatcccaaattatttttacctacgcctgatatgtatggattggactatgtgagctttattttgcctgacaaaatgacgatggccaatattttgatgaaccttgatgcggctggcttaacggattacgattatcaccatgagaaccagtttttgatgatcgctgggccgaatcgactgacgctatggtttcgagtggcgtaaccgatctggccttggatcggaaagaaggccaggatggattttcaagcagtaacgacagggttgcaaaaatgggtagcggagcagattgtgccgggttttagtgttgcattgttaaccggtaagcgggttcaaaccaaggtggcaggtgaagcgcagtggctgccgcatccggaaccgctgcggcctaagatgctttatgatattgcttcattaactaaggttgtcggcactaccactgtctttttgcaggcgtgggatcatgggctggttgcgccaacgatgccgttaaaacagctgttgccggcgtttccacatgcgaccacgtttcagcaggcactgacgcatacatcgggacttgaggggtacattcctcatcgcgatgctttgcctgccccggctttaaaacatgcgctgctgactcaattagcggtgacaaatgaagtgaatcgcaaggtggtttaccgagatgtgaatttgctgctggttggttgggcacttgagaaagtgtatcaccaaccgattcaaaaactagtgacacggcaggttttgcggccactggatttgccacgagccacttttcaacctgaaacagcccaatgtgtgccgactacttatcagccactttcgggattacgacgcggggttgtgcatgatcccaagagtgccattttaggagcgcatagtggggcagccggcttatttgccagtttggatgatctgatcatatttacccagtatttattcggacttcgaaccgctgaagcttggccaaaacatgcccaagacctaacgcgtgactggaccgttcatcatcttgggcgcagtctcggatgggatctcagacatgacaatcagggccgcttatggctttatcacactggctataccggaactttttggttggttcaaccgcaaagtcaactggcactgattgtcttgacgaatcgcgtccatccgcagcccaatcaggaatttctgggaagacgcgatcagttggttcaccggtttttgaatgatcagccgatattagaccagtaatgcgtacacaaaaacagggccgacattcacgaccctgtttttgtgtgtatgttagctttaaccgcttaaaaaccgcctttaatatagccaccatcactgagttttttccgtagttgcagcatcgccgtgtacgttgcgaggacatagagttgttgctgcggcatttcctgaagcgtcgtgagcacgtcgccgagatctggcttaatggtaagcttggtttctggcactcccgctactttcagccttagggcaatatcttgatagcgctcgccgccaaccaggtagtcggcggcttttttgctcgcaacgaattcttcaaagttgccgtcccaaatccagctcgtatcaataccatccgcgtaattggcgttcagtagcatcgcaaacccaaaaggctgcttggcggtttgaatcatgctcaaaacctgattcaggccaacgggatttttaactaaaatcaatgttagctttttggccccgagttgaatgacttcttggcgtccgaagactttttcatcgtaggcaaacgcttggctgatttgttcagggctgacatcaaacgttcggccaactgcaaatgcggcaagggcattgtagatgttgtacatgccgccaatgtcaatgtgacacggctgaccgtcaatgacaaactcactgctttgcggcgtcattttggtaacggcattaacttgataggtcaactcaggtcgtttgaaaccgcaattaggacagaagaagttacctagattagcgtaagtcaaagcgtgataatgcaaaatgtgctggcaaaccgggcaaagaacgccatccgtattcggcggggccttgtgatcgccttcgttggtcaacgtaaagccgtaataataaatcggattgggcaacttccgcgaactgaaaatcggcgcatccccattagcaagcacgacagcggtgggatcaagcgtgataccatcaagaatcttttggtaagttgtgtaaaactcaccatagcggtccatttggtcacggaaaatattggtcagcacaaacgctttaggcttcaactgcgcggcaacgggagcgacattggcttcgtcgacttccaaaacagcgatcccgcgaccatgaccgcttttgggctgggctaaaaaagcggtcgtaatcccttgtaacatgttggagccggtgggattggttaggacttcctgatatttttgtttgagtaccttgacgatcaagctagttgtgagcgttttaccattcgtaccggtgaccacgatcacatcatagttatggcctaatgcttgcagaacatggggatcgaggcggttagcgatttttccggggagactcgatccacctttgaaaaatgtgtgtaagaaccagtagctgctgcgaccaatggcagttgccaggctggcttttgctgaaaatgccacggcgttcttcctctcaacttaatgggactattttagcataacttgaaatcaaaccggcagccggagtgttctttgcgaaaaaaatccgttatactgtgagacgtgagattttaaatggaggcggcatatggcccagcttttctttcgttatggcgcaatgaactcaggaaaaagtattgaaattctgaaagttgcccacaattatgaagaacaaaataagcgcgtgattttaatgaccagcgccgtggatgatcgcgccggtgttggcatgatcgccagtcgcattggtcttgagcggactgcgattccgattgcgcatgaaacgaatctgtatgatgtcattaaaacgactgatccgaaagcggcatgtgttttaattgatgaggcgcagtttttgcagaagcatcatatttttgaagctgcgcgggtggttgacgagttgcatattccagtcatggcgtttggcttgaagaacgatttccgcaatgagctgtttgaaggttcaaaatatttgttgctgtatgcggataagattgaagaaatgaagacgatttgctggttttgcgcgaaaaaggcgattatgaatttacggattcatgatggtaaaccggtgtacgaaggcgagcaggttttgattggtggcaatgaatcgtattatccggtttgccggcatcattattttcacccgccgttagatcggattgatcaggatgaggaatagatgtttggtcggtgtggtttggctggttcgcgctctgtcataacgcgctcaccggcgcagaagtctgcgtgcaaggacctcagccgcaatggccaaagcccggccatcacgtctgaggccacttacactccgacttctaaccgcgccggttcgcgctctatcataacgcgttcgccagcccagaaacctgcgtgtaaggaccttagccgcaatggccaaagcccggccatcacggctaaggccacttacactccggtttctaaccgggctggctcacgctcaggaggattttatggataagatttttgaacagttggacgggcttttggttcgttatgaggaactagaagagttgatgtcggatcctgaggttatcagtgatacgaaacgttacttggctttgtccaaagaagaaggcggcatgcgagatgttgtggctgcctataagaaatataaacaggtgctttctgatattaaagaaagcgaagaagtgcttcgtgagagtaaagacgaagacatggaagcgctggctaaggaagatctggaggacttgcagaagcaaaaggccgatcttgaagagaagattaaggtgctgatgctgcctaaggacccgaatgacgataagaacattattatggaaattcgcggggctgccggtggtgacgaagcgagtctttttgctggcgacttgttgaatatgtacatgcactatgcggaacggcaaggctggaaggcggagattgttgattcaacccctactgaagtcggcggttataaagaagtcgtcgtgatgattaccggtgacaacgtatactccaagcttaagtacgaaaacggtgcccaccgcgtgcaacgggttccagtaaccgaaagtgccggccgggtgcataccagtaccgcaactgttggtgtcatgccggaatatgacgaggttgatttgaagattgaccctaaagatattcggacggatgtttaccgttcttccggtgccggtggtcagcatgtcaacaagaccagttcagcggtccggatgacccatattccaaccgggattgttgtttccatgcaagacgagcgtagtcagcaggaaaatcgtgcccgggccatgcaaattttacggtcacgggtttatgactattacgaaaccgaaaatcaggaaaaatacgatcaaaatcgtaagaatgcgattgggaccggtgatcgttccgaacgcattcgaacctataattacccacaaaatcgggtaaccgatcaccgtattggcttgacgcttaataagctggaccgcattatgaatggcgaactggatgaaattattgatgcgctgattgtccacgatcaggcgcagaagatggaatcgctcaatgtctaaaacatatgctgaggcgctcaagtgggcgtctttgttattgaccaagcaaaaagttgatcccgacggcgctcggtacgtcctcatgacacgcgctgactggacgccgagccaattgattttgcatcgccaagatccgatgccggatgctgcctggcgtcaatttcaggcggatgttgcgcgattggccaactttgagccggcacaatacattaccggtcaagcgcctttttttggcacgatgtttgctgtgaccccagcggttttaattccccgatttgaaaccgaagaacttgttgcatgggttgcagaggagcaaacgaatgcacaaaccggcctcgatatggggacaggcagtggggcgattgggttaaccctcgcccgtcagttgccacaaattgacatgacgttgagcgaggtttccccgtccgctttggctgtcgcgaagcacaatgccgcggcacagaaagtgaacgtgcattttgtgaccagtgatttattcaaccacctgcctggacgctttgattttgtggtgaccaatctgccttacattgcgcctgaagaaacctcggtgatggatcaaagtacgttacggtatgaacccaagttggcgctgtttgctgatcatcatggcttggcattatttgaacggtttgtcactgaactgccgcaacatctaaacccgcatggcgcagcgtatttggagtttggctatcatcaggaaccggcactgcgacaattatttgctgaaaagctgccgcaagctcaagcaacttttcgccgcgacatggctgggcatccgcgcatggtcaaacttcaattttaggttgccattgtcagaagaagacacgtcatctttcagctcaagtccgatgatgtggtattttagtaaaaacgaacagtcaatggatatggaggcatcattttggcaaaacgttatcatgaatcagatattccggaagcagcagccgctttaaaacgtggtgagttggtcgcttttccaactgaaacggtttatgggttgggagcggatgcgactaatgttacggcggttagtcaagtttatgctgctaaggggcgcccatcggataatccattgattgtgacggtagccgatgcggcaatggttagtcagtatgccacgattaccccggatgcggcgaaactcatggacaccttttggccggggccgctgacgattattttgaatattttgccagggcgtttgtcaatgaaggtgacaggcgggttgcaaaccgcggcatttcgcaatccggatgacgcgttaacccgaaagttgatcgcaaccgctggcgtgccgattgtgggaccgtctgccaatacatcgggcaagccaagtccgacaacggccgatcacgtgttgcacgatctagccgataaaattgccggcgtccttgatgatgggccaacccgagtcggagttgaatcaaccattattgatttaaccgtgaccccaccagctattttgcgaccgggtgcaattggaccgcatgaattggaaccgttgcttggaccagtcgactcggcggcgcatcacgtaggcaaaaacgaagcaccgaaagcgccggggatgaaatacaaacattacgcaccagcagcgcaagtcgttgtagtggatacgattgatcaatttgatgatgcagtggcgtgggctaaaaagacgggccaaacttttggacttttggcaacggatccgattcttgcccattttcccgatgtgcctagttactcgttgggtcaagatattaccagtgctacacatgccttatttgccgggttgcgctggtttgacttacatccggacgtgacactcgtgctggctcaagcctttagctacagcgaattaagtgccgcttatatgaatcgactgcttaaatcggctgggaacatgcactatcaaccgaatatgccaacggatcggttttgatttgctataatatagccaactgacagcaacaagtcggttggctatttttgtgagcgtgaaccggcgcggttagggatcggagtgtaagcggcctcaggcgtgatggccgggttttggccattgcgcctgaggtccttacacgcagatccctgcgccggtgaacgcgttatgattaagcgcaacgtgttggggaaatctagtcaacgtgctttggcatttgctagtttgcacgggttaaacggcgatcatctatcgataggtggatgaatcgattttaaaaggagagtggtaggcatggatttaatggcgcatgatccagaagttttccgcgcaattcacgaagaagaagcgcgtcaggaacataatatcgaattaattgcttcggaaaatattgtttctccggcagtgcgggcggcacaagggtcggtgttgacgaataagtattctgaaggctatcccggtcatcgttattacggtggcaatcaatacatagacgtggttgaaaatcttgctattgagcgggcgaagaagctttttggtgctgaatttgccaatgttcagccgcattctggttcgcaggcaaacatggcggcatatcgggcgtttcttgaagacggcgataaggttttggccatggacttgacggatggcgggcatctcacccatggcagtccagtcagttttagtggtcaggaatatcatttctaccattatggtttggacccgaaaacagagcgcctcgactatgccaaaattcgcgagcaggcagaacaagtcaagccgcgtttgattgtggctggtgcgtccgcttacagtcgggaaattgattttaaaaaattccgcgaaattgctgatcatgtcggtgcctttttaatggttgatatggcgcacattgcgggcttggttgcggcgggattgcacatgaatccggtgccgtattcagatgtggtcacgaccacaacgcataagaccttgcggggaccgcgtgggggcatgattttggctaaggcggagtatggcaaagcaattaattcagccttgttccccggcattcaaggcggaccactggatcatgtagtggcagctaaggcggtggcattaggcgaagcgttgcagccggcgtttaagacttacgcgcagcagattattgacaacatgcatgcgatggtggcaggtttcaaggaggatgaacacttacgcttgatttccggcgggtctgacaatcacatggtcttagtcgatgtcaccggttacggggtcaatggacgccaggttcaggacttgctggatgaagtcgatatcaccacgaacaagaatcaaattcccggcgagcaaaatggtccgtttaaaaccagcggcattcgggtcgggacagctgcgattacgacgcgtggatttacgccagaagaaagcaaacgcgtggcagaactcatcagcatggccattgcgcatcgcgacgaacaaccggttttggatcaaattcggcaagaagttcttgcactgactgcccgtcatcccttatcatagatagggtttgcaaacaaatggttctcacaggaggcgcttcatgggtaaatttacagttttaaatcacccgttgattcagcacaagcttacgttaattcgcgacaagcatgctggcaccaaggaatttcgcgaaatcgctaatgaaatcgcggaattaatggtgtatgaaattacgcgggatctaccgcttgaaagtatcgaaatcgaaacgccgatgggcaaaacggttcaaaaacagcttgctggcaagaagcttgctgtgattccgattcttcgggccgggctagggatggttgatggcgtcttgcggctaattcctgctgcaaaagtcggccatatcggtatgtatcgtgacgaaaagacgctaaagccgcacgagtattttgttaagatgccgccggatattgaccagcgtgatctgatcattgttgatccgatgctggcaaccgggggctcggctaacatggccattgaagcgctcaaaaagcgtggcgctacttctatgcggttggtagtgctggtggcggcaccagaaggcgttaaagcagttcaggcggctaacccggatgttgatatttatgccgctgcacttgatgatcatttaaatgagaacggttatattgttcctggtctcggtgacgccggcgacagactttttgggacaaaataacatgatttggcatgtggccgtgcacatgcctttttcatttttagttaaaataatttttatggtgcgtcaaggcagggagaatctgttgtctgatgtgaaaacatgagtgaaaaagcctctatggcggcaaaagtttctgcttttctggctttgtcttttcatcgaaatggtgttagagtaatgattgtgtttcaagggtataccctagtatcaacgattatcgaagtctccgtaatcttgcatcatcggtttgatgatacatacgatatgacgccgcttcagtaaggaggtgaattctgtgaacgaacaatatccctcgatcaagcttttcggcttaaatttcaacctgaccaatgacattggcgtattggtttcggcgatcttggtattcttactggtgttttggctgtcacgcaatttgcagatgcggcctggcgcaaagcaaaacatcttggaatggattatgaattttacgaacggcattgtgaagggtgcaattcccggttcacaacggtacacttttaacctgtttgcatttacgctgttcttgttcattttcattagtaatcagattgggttgttccttgagcttgatattggcaaagacacctggtttcgttcgccaacagcatcgcctgtcattaccatgacattggccatgacagtattggttatttcacattattttgggattgtttttaagggtttcaagggatatctcaagggatatgtgtcaccgatcggaatcctgcttccaatcaacctattggaagagtttacgaactttattacactttccttacggttgtatgggaatattttcgccggtgaagttttagttttactcattaggcagcttgctttttcgggcggagcgtttagttttgtttcaggggtcttgcttgagatcgtttggcaaggcttctcagtcttcattggtagtattcaagcgtacgttttcgtcacgcttggtatggtttatacgtcacacaaagttgtgtccgagtaattaatttaggaggaaatttcatatgcaattcatcgctgcatcaatcgccgctggcatcgctgctctcggtgcttcaatcggtaatgggatggttatcagcaagacacttgaaggtatggcgcgtcagccagaaatggccgggaccttgcgtggtacgatgttcatcggtgttggcttgatcgaagctgttccgattatttctgttgttattgccttcatgttgatgcttcgttaattttgagtcatcaataaagaagggagtggcaaaagatgagtttaggtgacacactcttcacgctcgtcacatttttggtcctgatgatcgcggtcgggaaagttgcttggaagcccgtctcaaagatgatggcggagcgccaacaaaaaatttccggcgacttggattatgctgaaaagtcccgcaaagatgccgaggcattagcggctaagcgtcgagaagcgctgcaacacgcccaagccgatgctgttaagattgtcaatcaagctaaggaaaatggtgaaaaacaacgccaatcattggttgacgctgctaacaccgaagtcgctacgttaaagaaaaatgcgcaagcggacattgaccaagcgcgcaaagacgcactggccagtgccaaaaatgatgtggcagatttaagtttaaccattgcccagaagctgattggcaaggagcttaatgcagacgatcaaaaagacttgatcgacgactatatcaaacggttaggtgatgcaaatggcagtcactaatcaaatggttgcaccgcgttatgctaaagcgttgttagaagcggcgcatgaccaaaatcaggtggagacggttcatgaagagttacaggcgttagcgtctgtattcaaagaaaatccaacaatcctgacaatttttgacaatgcccgaatttcagccgcagacaaagccaacttgttgacaactttgaccaaggatgcaagcccacttgttgctaacttgttaaagttgacccaacagtatggccgattcggtgcattaccggcaattatcacgacgtttaatcgcgcctatgatgatgaagccggcattattgcagcaactgtgacgactgcagttgctttgtcagccgaccaagccgatgctttacgcagttctattgctgagcgttttggcatgaaattgacccagcttaagcaaatcgttgatccaagtgtgatcggcggtgttcgcattcaagctcgcggttcggttattgatggtacggtcaagcaccgctttgagaagatgaaagcggcactgctggcagattagagataagtaaagaggtgaaccggatgagcatcaagactgaggaaatcagttctctgatcaaaaaacaacttgaaggatatcaagatgatttggcggctgaagaagttggcactgtaacctacattggtgacgggattgcccgcgccacggggttggaaaatgccatggccaacgaattgctccaatttagtaatggctcatacgggatggcgttaaaccttgaaacgaatgatgtcgggatcattatcttaggtgacttcgatgagattcgcgaaggtgaccaggttaaacgaaccggtcgtattatggaagttcctgttggggaagccatgattggtcgggttgttaactccttgggtcagccagttgatggcttaggtgcgattaagacggataaaacccgcccaatcgaatttaaggcaccgggggttatgcaacgtcaatccgtgtcagaacctttgcaaaccggactaaaagcgattgatgccttggttccgatcggccgtggtcagcgtgagttgattatcggtgatcggaagaccggaaaaacatcaattgcgattgatacgattttgaatcaaaaagatcaaaatatgatctgtgtttacgttgcgattgggcaaaaggacagcacggttcgtgcccaagttgaaacgttgaagaaatatggcgcgatggattataccattgtgctaaccgctggcccatccgaacccgcaccaatgctatacattgcgccttatgccggtgcggcgatgggtgaggaattcatgtacaatggcaaacacgttttgatcgtgtatgatgacctaagcaagcaggcaacttcatatcgtgagctgtccttgctgcttcgtcgtccgcctggtcgtgaagcctatcctggggatattttctatacgcacagtcgtttactagaacgggccgcaaaactaagcgacaagcttggtggtggctccatgactgctttgcctgtgattgaaacccaggcaggcgatatttctgcttatattccgaccaacgttatttcaattacggatggtcagattttcctgcaaagtgatttgttctatgcgggcacacgtccagcgattgatgctggtgcgtctgtttctcgtgtcggcggtgatgctcaagtcaaagcgatgaagaaggttgctgggacattgcggttggatctggcatccttccgtgaacttgaagcctttacgcagtttggctctgacttggatgcagctacacaggcaaaattgaatcgtggccgtcgaacagttgaagtgttgaagcagccggtacacaagccattgccagtcgaaaagcaagtgctgattctttatgccttgacccatggcttccttgatccaattccaattgaagatattggccgtttccaagacgaaatgtttgatttctttgatagcaatgcagctgatctgctgaagcaaattcgcgataccggtaatttaccggataccgataagcttgatgcgcagattaaggcgtttgctggcggcttccaaacaagcaaacaacttgctgcagctaaaggttaaggaggtgccgcatggctgagtcattaatggatatcaagcgcaagatcgcttcgaccaagaaaaccggtcagatcacgcaagccatgcagatggtttccggcgccaaattgagccagatcgaaaagcgtgccaagaagtatcaaatttactctgacaaagtgcgccagattgtgactcatttagctgcgggtcaacttcttgaactagctactgctgcgaatgatgacactgagacagataagaatcaggtcatttccgttgctagcttgcttcagaagcgacctgtcaaaaagacgggctatcttgtgatcacaagtgatcgcggattagtcggcagttataacagcacggtattaaaagccatgatgcagatgattaaagatgaccacgaaagccctgacgattacgtcatgatggcaatcggtggtgtcggcgctgacttttttaaagcccgcggtatgaatctggcttatgaatatcgtggcgtttccgatatcccgacttttaatgaggtacgggagattgtgaaaactgctgtgaccatgtatgacaacggtgtctttgacgagctatacgtttgttataaccaccatgtcaacacattaacctctgcttttcgggcagagaaaatgttgccaattagtgatttggatgtcagtgaagttgaagataccaatgttgagtatcttgtcgaacctgatcttgatgccgtcttagatgcggtgttaccgcaatatgcggaaagcttgatctttggtgcgatcatggatgcgaaaacagcggagcacgcggcttcgacaactgctatgcgtagtgctactgataatgccaatgatctgatttcacatctgtcgactcagtataaccgagcacgacaggctgcgattacgaccgagattaccgaaattgtcggtggtgcggcagcattggaataaatattgcgtttgttggcgcagggggctgtttgtgaggagtttggttgtaatggctggagtcgagccatcaagtctagagacacttacattcaggactctaatgtgccagcttatgcccataacgcgttcactggcgcagggacctgcatgtaaggaccttggtcgcaatgaccaaagcccagtcatcacgcccaaggccgcttacattccggtccctaaccgcgccagttcacgctcataacgcgttcaccagcgcagaagtctgcgtgtaaggaccttagccgcaatggccaagaccgggccatcacgtttaaggccacttacactccgacttctaagcgcgctggttcacgctcacttttacaacaggaggacgaatatgccaaattcaactggtaaaatcgcgcaagtgatcggtcctgttgtcgacgtagccttcccaatcaatgacaatttgccagaaattaacaacgccttgacgattacccgtaaggacggctctcagcttgtgctggaagttgcgctggaactgggtgatggtgtgatgcggactatcgcgatggattcgactgatggtttgcaacgcggcatggcggttgaagatactggcggtccgatttcagtgcctgtcggtaaagacacactgggtcgcgtgttcaatgtattgggtgacccgatcgatgacggtgaggcttttggacctgatcatcggcgtgacagcatccaccgtgatgcaccaaaatttgaagatttgaataccagttctgagattctggaaactggcatcaaagtcatcgatttgctcgaaccttacctgcgaggcgggaaggttggacttttcggtggtgccggtgttggtaaaaccgttttgattcaggaactgattcataacattgctgaagagcatggcggcatctccgtcttcaccggggtcggcgaacgaacccgtgaagggaacgacctttacttcgaaatgaaggaaagcggcgttctggagaatacagcgatggtctttggtcagatgaatgagccgcctggtgcccggatgcgggttgccttgactggactgacgattgcggagtacttccgtgatgtcgaaggtcaagacgtcctgctgttcatcgacaacattttccggttcacccaggctggttctgaagtttcggccttgcttggtcggattccttcagctgttggttatcagccaacgttggctactgaaatgggtcagttgcaggaacggattacgtcgactaaaaaaggatcggttacatcgattcaggcgatttatgttcctgctgatgactataccgatccggcgccagcgacaacatttgcccatttggatgccacgactaacttggagcggcgtttgactgaacaagggatttatccggctgtggatccgctggagtcatcttcaagtgctttgaccccggaaattgtcggtgaagaacattataaagtcgcaacagaagtccaacaggttctccaacgttaccgtgagttgcaggatattatctctatcttagggatggatgaattatcagacgaggaaaaggttatcgttgcccgtgctcgtcgggttcaattcttcctgtcacagaactttaacgttgcggaacggttcactggtcagccgggttcttatgtaccggttgaagaaacggtcaaaggctttaaacaaattctggaaggcaagtacgatgactatccagaagatgcattccgttcagttggacggattgaagaagtcgttgaaaaggctaaaaagatgggctttgctcctaatgatcaggacacggatgctgacgaaaagccagctgcacaagctgcagctaactaaggaggcgacgcgttttggcagaaacgagcaatgttctgcgggttaacatcgtgacgcctgatggtttggtatatgaccatcatgcaaagatgttagtcgttcattcggtcgccggtgaattggggatcatggcgaatcatgagccgattgtcacgccccttgaaataggggaagttgacgttcagcgggttgattcaagtgatcataacgactcaattgcggtgaatggcggctttatggaagtttcagataatgttgcttctattgtcgctgattcagccgagcgtgaacgcgatattgaccttagtcgtgcgcaagctgcacgtgaccgggccaagaagcggatcgctcaggccaaggatgaaaataaccaagatgatctacggcgggcgcaagtcgcactacgacgggcaatcaaccggatcaacgttaaaaccagtcactagtcagtgattggaaggtgatcagtcgttgcggcgttagctccacgataatcaccttgatacgccaatgtggctggattgacacacaggcgcaaaagaaggtgtcttattttccaaacttaacggaaaaataggacactttttttgaatgggttggtttttttacgatcctaatcccaagctcggcatatgccataacgcgctccccggatgcagaagtcgaggtgtgagtgccttgagtgcaatggccaagcctgagccatcacgcctgaggccacttacactccgacttctaagcgcgccggctcgcgctcaccataacgtgttcgccagcccagaaacctgcacataaggaccttgggcgtaatggccaagcccgggccatcacgcccaaggccgcttatgctccggtttctaaccgggctggctcacgctcactttctataacgcgctccccggcgcagaagtctgcgtgtaaggaacttaagcgcaatggcaaagcctggccatcacgcttaaggccacttacactccgacttctaagcgcgccggctcgcactcaccataacgcgttcgccagcccagaaacctgcacataaggaccttgggcgcaatggccaagctcgggccgtcacgcccaaggccgcttctgctccggtttctaaccgggctggctcacgctcacttaggcttgcgtgattgttgaaagtgcgggaagatgttctgtgaggtgatcgcatgtttcaggaaatcggcctaaatgctgccataacccttgtttcccattttgttttcatcatggtggcatttcgggcgttgaatgcattacgctttgagcagtttattaaggccaatcatgttcgcgaggcacaggtgctgttactttttatggcagttggcttaggttatttagttagttccttctttttatcactggttcaagcagctttaaacttacctaaacttttcctataaaaacctcgtcttaactatgttataatgcgatagttagtcaatttacgaggagagatatatacccatggcaaaagatattgggatcgacttagggacggccaatgtactaatcaatgttaaaggcaaaggcatcgtcttgaatgagccgtccgttgtcgccattgatacccataccggcaaagtgctggcagttgggacagaagcctacaaaatggttgggcgcacaccgggtaacattcgatcaattcgcccattaaaagatggcgtgatcgctgatttcgacattaccgaagcaatgcttgaatatttcattaacaaattaaatgtaaaaggcgttttttcaaaaccaaatattttgatttgtgcccctactaatattacagacattgaacaaaaggctattatccaggcggcggaaaagtctggtggccgccatgtttaccttgagtttgagcctaaggtagcagcggtcggagcaggattggacattttccagccgcaaggaaacatggtgattgatatcggtggcgggaccagcgatattgccgtgctttcgctgggggagattgttaccagtcgttcactgcggttagctggcgataaaatggatgcgtccattgctgcttacgtaaagaacaagcacaagctgattattggtgaacatactgccgaacaaatcaagatcaagatcggtgcggtttatgatgccgatcctaaagaaacgattgaagttcggggtcgcgatattgcaaccggactgccacgcgaggtttcggtaacctcagctgaagtgtcagatgcgttacatgagaccatgatggcgattattgatggcgccaaaggggttttggagaagaccccgccggaactttcggctgatattattgatcgcggtatcatgctgacaggcggtggtgccttattgaaaggtatttcacagctatttgccgacgaattgaaagtaccggttctgctggctgacgatcctttagatgcagtggcactgggaacaggcgtgttattagacaatattgaacatcatcgccaatactaggagttgtcacttatggactcgcaatatcctaaacgcgtttttcatcacgtcaagatttggctgattattgcgttgattgccttgattttgggcttgttaatcggctttggtatgggtggcgataatccatttaaggtgtttttgccttcaacctggatccatttctttaacttcttacgttaggagtggacatgaaacaaatcctgacttggctggtgcggggctaccagcgatttatttccccgttatttccgccgagttgtcggtattatccgacttgttcgacgtatatgattcaggcattgcaacgacatggggcggtaaaaggatttttaatggggattgctcggattttacgatgcaacccctttgttaaaggtgggctagatccggtgccagcttattttacgttgcggcgtaatccgcatcccgaaaatgatttggatcttagtgacattcaaaatcttaatcgcaagctaggaggccatcatggctaaagaaaaaaatattaaagtcgcacagatggatgaaacccgcaatggccacacggtttctgtcttaagaatcggcgatcaggagattggttttatcgaaccggatggcacgcggtttgccgcttatgttgccggttctaacaaacccaatcgctttaaaaatattgatgatgcagtgaatgctttaattgcggaatatcatttgcatcaaggctgagcaattttcttttgttaaaataacggtaacaataacctagcgaaacactgtaggtgaatgactaacctagcttttaacggtgtggcaatgggttcatgaatgtggtgtaaggaggctggccgtggaatcgcatgaaatcaaatccaattctgaaggcgatcgcatcgactacggtattattctgtcggtcatgctgctggctttgattggactagtctcgatttatttggcgaccgctcatgatacgacaacgcttcaaaatccggttcgcgcaaccatcatgcaggctgcttggtacgtgattggcggcatcggaattttctttgtgatgcgttttgacgctgagcaactttggcggattgcgccttatctttacgggattggcattttcttgatgattgccgttttgattttttatgataaaacgacggcgattaatacaggggctaaaagctggtttgctttgggaccggttagttttcagccttcagagattatgaaacctgcgtatattttgatgctgagtcgggtcgtgacccagcacaatgccgctttttcgcacacgattcagcatgattggcagctgatcggacgcatggttttatggaccttgccgattgcgatattgatgaagttacaaaatgactttgggacaacgctggtatttttggcgatttttgccggggtcactttagttgccggcattaactggcgcattttattgcccatcgctttaattggggcagccattggaacgctggcaatcttgctggtaacccaatcgtgggggcggtctttccttggatccattggctttaagacgtatcagtttgcgcggattgactcatggttgaacccttctggcagcacaagtggcgacagttatcaattgtggcagtcgatgaaagcgatcggatccggacaattaaccgggaaaggcgcgtttcatatcgccgttgcggttccggttcgggaatcggatatgattttctcggtcatcggtgaggcgttcggatttatcggcgcggctgtgttgattctgttatactttatgttgatctatcagatgattcgggtgacatttgacaccaaaaatgagttctatgcttatatctcgacaggagtcatcatgatgatcttattccatgtgtttgaaaatatcggtatgaatattggcttgttgccactgacagggattccgttaccgttcatttcgcaagggggatcattcttattggcgaatatgttatcggttgggatggtactatccatgcgttatcatcacacgagctatatgttcagccgggacacagaagattttgaataggggagattataatggcgacaacgtatttttggcaagatgaattggctgcaggacaagttcgcttgggcttgacgcaagaagctcaggaagcgttgggcaagatcaggtttgtggacctgcctgaaattggtaccagcttaaccgtgggcaaacccttcttgagtgtggaagctgaaaaggccgtgctagatcttgaggcaccgctggctggtacggttgttgatgttcatcgtgagctcagcgataaacctgctttgttagacgaaaccgatcataacgataattgggctgtcacggtttcaaccaaataagcgccagcaatcaatcgtgttgtgacttctcacagcgtaaaaaaagcagtcgggtcaacgataatgactcggctgcttttgacttttggaaaaggttattaacactgccataagtggcggacttgagcttcaggcaaaaaagcgtttggcaatttcttcgtaagttttaatcgctgtcgtgtagctatctaaatcaacatgttcgtcaatctgatgactgaaatgattatcgccgggaccatagacaatcacgtcaaactggttatcggaacggatgaattctgacgcgtcggttccgccaaaagccaccgctaactcggctggcttaccagtcacagcggcaatggcttcgttagcggttgtcacgagatgcccgtttttgtcagagtgtaccggcaaaaaacgatgtaaaacgttcaacgtcaagttagcggcggtggctttatttgcctgatcgactaatttttccaataacccgacgactaattcgatatttgctgcaggagtcgggcgcaagttgccgcgtaagtatgcatgggcaggaatggtgttgacttgatcgccgcctttgatcacggtaatggagtggcggaatggaccaaggtcaggatcatcaggggcctgatcaaaggcgtgcggttcgcgagtagaaaatgccaccaacccttcaattgcgttaacgcctttttccggccgggagctgtggacggaaacgccttcgctgtcaatttcgtagttaaccgttccgccgtgtgcgtattttagcaatttgttcgttggttcgcctaccacgagtccggctaagtcatcggcataaccttgttcggtgagttggcgcgctcccattgcaccaaactcttcaccgaccgtggccatgaaacgcagcggatgggcaaagccgctttgcttaaggtggatcagtgccaaggtcatggctgctagcccacttttcatatcatcggtgccgcgaccgtacatggtgttgttcacgatctttccggaaaaaggcggataggtccaggcgttctcatcgccgggactcaccacgtcttcatggccggtgaagcctaatacgcggtcaccgtgattgagctgggcgactaaattgacccgatcatctttgtatgggatcaatttggttggaatatcggccgcttcgagttcagcttgcaaaacgcgggctactgcaagttcgtttccatttgcagagtcaatttggattagtttttgcaaaaacgcaatgggatctgtcatgtttgatcatcctttccgtatgccggctgtgtgattggcgatttgaaaatgtcatgtcggtgttgaagacagcttacactctttttgaattaaaattcaatgattgactaccaagaaatttgtgctaaactcatgaatacaaacttgaaattgatgataaacggactgagtgagtagtgatcgcaagacagtacagaaaacctgtagtgatgagagcagggttgtgagtgatcatgaacatggcttagtgcacacggcacaccgagcatttttgcaaggctgtgatggttggcgcccattatcgtgctcccggatgaatacgtccggtgagtgggtcgcgtttttcgtggccaattagaatggtaccgtgggccaaagctcacttctaacagcaactgttaggggtgggctttttttattgggttcattgattggcgatttcaggtaaatgcggcaagttaataaatcgtacttggtgcaaacaaatgaggaggatgcaggatgaagcgtatctggaaaatttttgcaacggtggttcttttaggattgattttggtaggctgcggaaaaagtggcagtcaagctagcagtcagaagcagacaacggtcaagattggggttgtcggtgctgataatcgcgttttaaaggcagtcgccaagaaagttaagaagcaaggaatcaatattaagattgttcagttttcagattacaaccagcccaacaccgctttgaaagatcatgatattgacttgaacttattccagcatcaatatttcttgaataactggaataaaacccataacgctgatttggttagcattgggcagaccattattgcaccgctagccatttattccaaaaagatcacgaaaatcagccaaattaagcaaggcgacacaattgccttaccaaatgatccgacaaatgaaggtcgtgcgctgcaattgctgcaaacagctgggttgatcaagcttaacaagaaagtggctttgtcgacaacgcgcgatgtgaccaccaataaattgaatctgaaacttaaagccgttgatgctgctcaaactgccagctctttaccggatgtggcagcgtctgttgttaattccggcgttgctcaggatgctaagttaaatccgaagaaggcagtctttactgagaaagtgaataagcaaagccaaccgtggattaacgtctttgtagctaataagaaagataagaataacgccacttacaagaagattgtgaaggcttttcggactaaggatatcgctgatttgattgaaaagttgtatcacggaagcgaagtaccggcttggacgcagaagttttagttagatgtttgttttgggggatgtgagcggggttcatgcttcaccatgatgagattccggggcgtgtaagtacctcgcttgcaatggtcaaatccgggtcgtcacgactgaggccgcttatgttctggcttacgcccataacgcgctccccggcgtagaagtctgcgtgtaaggaccttggtcgcaatggccagacccgggacatcacgcccaaggccacaagtccgcctttacgcccataacgcgttcaccggcgcaggaatctgcgtgtaaggacctgagtcgcaatggccaagagcgggccatcacgtctgaggccgctgacattctagcttacgcccataacgcgctccccggcgcagggacctgcatgtaaggaccttggtcgcaatggccaaagcccggccatcacgaccaaggccacttacactccggtccctaaccgcgccggctcgcgcttactttactttttacttgacaatgaccacttttatcgtctagaatcgatttaattcatttagggaaacgaatgatatgagtgagtagatttgatgagactgtacagaaaacctggttggctgagagcagggtagttgattgaattgaagatggctcattgatcggcatcgctgagcattggttaagcgatgatggctggcggtcattattccgcacacaggttattgcctgttactgagggcgctttggcgtcgaattagaatggtaccgcgagttaactcgcttctaaaacattgttttggaagcgggttttttttaattttcggcaaattgctgacacatattgtttgtgacccgaacgaggaggaaaaagtttatgaagttttggaaaagagccattataacccttgcattggttttacctgtcttcgtcttggcggcgtgcggtaagtcgtcatcgagttccagtaagaatgagacggttaaagtcggcattatgagtactgacaaagaaatctggaccgatattcagtcccgcttgaagaagcaaggcgtcaccattaagttggtgcagtttactgattataaccagccgaaccaagcacttgaagatggcgatattcaactgaacgcttttcagcatcataatttcctgaataactggaataagaagcacaataccaagattgccgatattggcgatacttatatcggcccaatgcgtgcgtattccaataaaatcaagtcacttaaagaggttaagcaaggcgatcagatttccttgccaaacgatccatccaacgaaggccgcgcattacaacttttggcacaaaataagttaatcactttgaagaaaggcgttgcttcaccaacgatccgcgatattacttcaaacaagattaacttgaaattcacggaactggatgccgcccaaacagcacgctcattgaacgatgtggccgttgcggttgtcaacaatgatattgccgcagcagctaatctgaaaccgtccaacgcgattgccgttgaaaagattacgagccaatccaagccgtgggtcaactttatcgctgctaagtcttctaaggataagaacaatgcaacctataagaagattgttaaggcctatcagacaaagcggacagctgaattgttgaagaaggtttataaaggttcaacattaccggcttggaactataagttttaattagaaacggggacaattatgtcagatcaagcagttgtgactttaaaagatgtggacgtcgaattccacggtaaaaaccgttcagtccatgccgttgaccatgtaaacctaaccgtcaaccgcggcgacatttatggcattgtcggctattcaggcgccggtaagtccacacttgttcggacaatcaatttactgcaacggccaactggcggcagcattcatgtattaggacaggatatgcttgctttatcaccggcagaattacgtaaagaacgtaaacggatcgggatgattttccagcattttaatttgatgaatagccgcaccattgccgataatgttgcgtttccgctaaaaggtatcaagtccaagcaggagattcaaaagaaggttgctgagctgttagacctcgttgggttgacagatcgcgccaatgcttatccggcccaattatccggtggccaaaagcagcgcgtcggtattgcgcgggcgcttgcttctgatcctgagattttgatttcagatgaagcgacgagtgcgttggatcctaaaacgaccagttcgattctggaattactgcagtcgctgaacaaacggctgggactgaccattgttctcattacccaccaaatggaagcggtgaagcagatttgtaatcgggtcgccgtgatggatgccggcgcgatcattgagcgtggtgacttattgcaagtcttttctgatcctaagcaacagttgactaaagatttcattgatacaactttgcaactggatcaggcaattgaagccgtgatgcagcagccggcagttaagaatctgggtgctaatgaccggctattgcgcttaacgtatgtaggagattctgcggataagccgctggttgccaagttgtttgaaagctatcatgtgaccgccaatatcttgtttggtgatattcaaatcctgcaggacacgccttttggcaatctgattgtggtgttatcaggtgctcaagcggatgttaatgccgggattcattatctggaacaacaggatgtcaagattgaagacattcttaagaaggaggcctaagcagatggcacaattttttacaaaatattttcctaacgttgttcccatctggtccggtgatggcggcgtaactcaagccattaacgaaacgctgtatatgactgctttaaccgcaatcgtggctggtatcttgggaattatcatcggcatcttgctagttttgactgatgaaggtgggttgcttgccaatcatccgttttactttattttggataaattggttaatattttccgagcggtccctttcatcattttgctggcgattatgacgcccgtgacccgagcaattgttggtacggggattgggccgactgcggcattggtacctttaatcgccggcacgaccccgttttacgcgcggcaggtacaaaacgcgttgttaacggttgatccaggtgtgattgaagcggcagaggcgatgggtgtttcgccattaggaattgtctggcgggtttatctgcgtgaaggactttccgaattgattcgggtttcggttttgaccattatttccgtgatcggcttaactgcaatggcaggcgcggtcggtggcggcggcctcgggaaccttgctatcgccgtgggttaccaacgttatcaatatgatgtgatcatcgtatctttgatcttcatcttggcattggtcttcctagttcaattcatcggcgacttctttgcccgcaagagtcatcattagaatttaagctgatttggcagcactctcgtttgagtgctgccttttcctttacacgcgtccaaacaaccatgaacgattaactttatagaaagcaaaaaaagttgccgtgtttgccggtatactgtttctgacgtaaaatgaccctataactaaaagtcaaatccattcgggggtaacgttgtgcatacacttgagattaaagatttacatgtcaaaattaaagctgaaccagagcgtccggagattctgaccggcgttaacttaaaattagcaaccggcgagattcatgcgatcatggggcctaatggtacgggtaagtcaacgctagccgaaacgattatgggcaatcctgcttatgaggtaacgcaaggcgacattttgattgacggccaatcgattctcgatcttgccgtggatgagcgtgcgcgagccggattgtttcttggcatgcagtatccccaagaaatagccggcgtgacaaatgctgaattcattcgggcggcaatcaatgcgcggcgcccagaagatgaccagattcgcattactgactttttgaaccaattggataaaaccatggcaacgctggaaatgccggagtcaatggcggatcggtacctgaatcaaggcttttccggcggtgagaagaagcgtaacgaaattctgcagctgatgatgattcacccgcattttggcctgctggacgagattgattccgggttggatattgatgcgctgcggattgttgcaaaaggcgtcaacttgatgcgcggtcctgagtttggcagcatgattattacccactatcagcgtttactcgattatattattccggatgtggtgcacgtcatgaaaggcgggcggatcatcgaaagcggcggcccggagctcgccaaagaactggaaaagactgggtatgaacatcttaaagtaggtgatcagaatggttgagaccaccaccttaccagcacctaatctgccgaaatttccacttgcacgttatttaaaaaatcaacctgatgccgttgaggatcgtgtgattttacatgctcctcaagacattgcctatgctgccggctccagcgaagcgcaacgatttactcccaaaacgagccttgatgcctggctgttgcaatcacctcaaggcgcaacgactatcgatattccagcgcattttgtcagtggggacgatccgattgtcttaactggtcccaagaacgctggcggcttgttgtatgttcatgttggcaagggggctaacgtcaccgtccaggaaaagtgggctagtggcggccatgtgctgggtatttggttaatgctagtgattgaagctgatgctcaggtcaattggttaagctatgatagtttctctgcggataccgttttggttaatcgcaccgccactttggctgacaatgctaaacttaactggacattagccggtttttcgcataactccggcctgaatcgggttgacgtccgcttattaggtcaaaatgctgaagcaacggtaaatgtcggcgtgttggcttcagggagtcagcgtgtcagctacacaacttctgtcaccaacgaagggcagcacacagttggccatattaaccagcgcggtgtcattaccgggagcgcccatttgttattcaatgggattggccatattgtcaaaggcgcccggggaagcgatgcccagcaggaaaatcgggtactgatgctgtcgccgcgtgctgaaggcgatgccaatccgattttgctcattgatgaaaatgacgtcaccgcggggcatgctgcttcggtgacgcgcgtcaatgctgatcaactctactatttaatgagtcgcggtctttcagcaacgttagccaaacgtctcgtgattcgcggctttttggaaggcggtttggctgagattgatgatcagcggctaaagaaagaactgtttgcaacgattgatcgaacgttggtggctgaagatgcgtgaacaatttcctttttttaaggctcatccaggattggtttatttagatactgcggcgacctcacaaaaaccgcaagccttgctggatagcctgcaaaactactatattaatgaaaatgccaatgtgcatcgcggcctttataagctggcttatgatacgactgaggcctatgaaggtgtgcggcaggaagtcgcggattttctgagtgccaaaagtgctgatgaaatcatctttacgcgcggcacgactgatagcctgaatctggtagcgagtgcattcggaccgcatgcagttcctgaaggcggacggattgtggttagcggtgcagaacatcacagtaactttattccgtggcagcaattagccaagcgtcaacatgccaagtttgaagtgaccccagtgcatcctgatgggatggtggacgtgcctgccttgcttgcagcgattacgcctgagaccaatttggttgccatcgcccaagtgactaatgttgccggtgatacgctaccgattgccgccattgccaaaaaggcgcatgcagttggcgcggtggtggtggttgatggcgctcaggcagtggcacatttgcccgttgatgtgcagacattaggtgcggatttttacgctttttccgggcataaaatttatgggccaacggggatcggggttctttatggtcgcgctgatcttctagccaaaatgccgccgattcagtttggcggggaaatgatttcagaagtccgcgatgatgtcagcacttgggcagaggggccgattaaatatgaggccggaacgcccaatattgccggtgtgatcggattagggacagcgctgcactggtttaagcaaaatgttgatgcagcggtattaaaaaccgaacacgacctgtctgatcagttgcgttcagggttggcggcgataccggacgtcacgatttatggcaatcaggcgagtctggcaacggtatcatttaacttggcaggtattcatccccatgatctggccacctttttagatgagcagcagattgccgttcgtgccggccatcattgcgctcaaccgttgatggcacgattaggggttccggcaaccgttcgcgcaagctttggcgtttacaacaatgctgatgatgttgctaagctagtcgaaacggtgcaggcggcaaggaggtatttccatggcgttgactaaactggatcaaatgtatcgtgcggtcattcttgacgaggcccaacacccgcggcatcatggtacgttaaccgatttcgatcatgaaataaccgtccgtaatcccagctgtggcgatgttttgcatttgcagattcgcgaacaggctggccgggtggatgatgttgccttttccggcagcgggtgtacgatctcgcaagcaagtgccagtttgatgacggagcagattttagggaaaacgcctgcagaaattgagcagatggtcgagactttttctgacttgattatcaatggttcggtgcctgacgcggagattctgggggatgctgctgttttaaaaggtgtccatcagtttccggcgcgcatcaaatgtgccactttagcttggaaagcagccgcgcaagttttgacgcagagaggtgaaaccgatgactgaaaccaaaaacactaaaaataatgaagtcgttgccgcggatatcgactttttaccggatgagaatcccgctgatttcaaagatgatatcaagccggtttactcgaccgggcgcggtttgaccgaagacacggttcgggctatttccgctgaaaagcatgagccggattggatgttggcatatcggttaaaggcttatgccacctaccgcaaactggccatgcctaactttggaccggacttatccgacttggacttagacaatatgctgtatttccaaaaggccacagatcgcacctatcgtgactgggaagacgttcctgataccatcaagaaaacgttcgaccgtctcggggtgccacaagccgagcgaaaatatctagctggggcgagtgcgcaatatgaatccgaagtggtttaccataatatgcgggatgaatttgaaaagcttggcattattttcatggatatggattcggccttgaaggaatatccagaattggttcacaaatacttcggaaaattggttaaacctagcgacaacaagtttgcggcgctcaacggggcagtgtggtccggcggtagttttatctatgtgcctaagggtgtgcaaaccgatgttccgattcaaagttattttcggattaatgccgagaacaccggccagtttgaacgcacgttgatcattgttgaacccggcgcacatgtgaactatgtcgaaggttgcacggcgccgaactattcaagcgacagcctgcatgccgcggtggttgaagtctttgtcaaaaacgatgcttactgtcgctataccacgattcaaaactggagcaagaatgttttctcgcttgaaacgaagcgggcgcaagcattggataatgccacgatggaatgggtcgatggtaatctcggcagtaagacaaccatgaagtatcccagcgtttacttggatggtaaaggcgcacacggcaccatgttgagcattgcggtcgccggcgaaggagtcgatcaggataatggcgcgcgtatgattcacaatgcccccaatactagcagctcgattgtgtccaagtcgattgccaaagatggcggcgcggtggattatcgcggcaccgtgcgtttcaccaagaaagccgacaacgctttttgccacgttgaatgcgacaccattttaatggacgaaaagagctccagcgatacgatcccgtacaatgagattcacaattcaaccgtttcaatggaacatgaagctaaggtttcaaaggtttccgaagaacagctgtattatttaatgagtcgcggcatttctgaagccaaagcaaccgaaatgattattatgggctttgttgaacccttcaccaaagaactgccaatggaatatgcggttgaacttaatcgcttgatcggcatggagatggatgggtctgtcggttaatgctttggtggcgcggtttgtcagactttcaggtcaccttccaggcctttcaggtatctggcaaaaacagctaagtgcaagtttttaagatgtatttatcagtcaaatatcaatgtagcctcagttgcggatggagccacagtgatgtttggctatttttttgtataaaatattaggcaagcctaactttttgggctatgatagatgcggcaccaaaaatgattctattgagggggctgcagatggataactacgacaaggcaagaaaggtcttgcaatcaatggcgttgtccaaaattgcacaggaaacaggcatcagtatcggtcagatctggcattaccgggatcgctatgagggcattcaaaaggcgccaccggcatatgttgagcgaatcgcaagcttgtatcgaaaaaaacgggtctagttggggcatacgctggtccggatacgaaaggggagactttcgtaagatcggttggactgattgaaaagtccggcactttgagtgtggtgactgatcagtcttgataggttgacaacgtcgataaggctcaatgactcagcaaagtgggtcattgagccttgtcgacgtttttgcaggtttaatgatgaccatggttggatactgatgcgatttagcaggctggctcacgttatgtgggggtgctacaatgaatgaatgtatgaatactcaccttaagctaaagaatgcggctggggtcgggtagcaatgtagctggattaataggaggcggatgatggctgaggacttggagcatttcatcaaggcgatggcgctggggattccaaccattaaaccggatgagaagcgagcatttttggggaattttcgcgaacgggtggcgatggcagtgacgattcgccaactgcgcgatgcccggatcaccgcaatgcttgattcagtcttgaagcgttaccccggttaccgaatatttttaaacggtcggatgggtgagagcttggtgaatcagtatatgatgcaggcgctggcacatcagtatccgtttacgatcatgaatcagcccggtatgcgcgtgaccaagcgggtattgccgacagactttggatgggtattggcacatccgacccagaaaataagtcggccgattttgttataagtaaacatgctaatcatgaaacagctaaggattttttagaggaggatcattttgacgcaacttgataccattcaaaccaccgtgcaacagttgcggatttcgttgaatcaaggcaagatcttcgcgactttaccggacatgctgggcaaagtcatcactagcatcgcgactgagccaaaaacgagtctgaaaattccccgggatgataaaacggctgtcgccagaattcgggctattcaaaagcgggttaaacaaacgagcgatccaagtgtgaccgatgatgaaattgcttttttggtcgcacacttagccagtaccaatccggctgttcgcgataaaggcgtgtttttcctgtttaacgatttgtttcaggctgaggcgttcacgaatgaacaagttaaggcactttttaagcgcttgcaggcacccgacattttgttcagccacatctttgaaccggaaaatgacgcgatttttctgcggagttttgccgttatgattctcagtgggatgatctacgcggatcagaatcgttaccatgttcttagcaaaaatgattatttgagcaccgtacaaaatatcggtacttatattttgctggagaaggatggtcgcggttatgttccgaataaaggctgggcgcatgcttttacccatatcgggaatatgcttgaggaattgagccaagtgccggttcttccgcgttcagaaaaggtctttttgatggctgccgttgttgaggcgtggcgacgggtcgaaaccccgttgatttttggagaagatcatcggctggcgctttatttcagtagcttaaccaacgtcaatcagttttatagtgaaacctttttgatgtgtctaaaaaattggcaacacacgctggtcaatgtgcggccacaggaatcataccgtttttgggtacagtggtataatcgcaatcgcttgttgcaggcattaacgttgcgcgctgatttaccgcagccgattgcggattatattcaacagattgttgatcttttttgagcgttcgaagcgccaagtcattaagatatttatttttggtattaatcggcgttgcagctgacgttcgccgatgtgagctggcaccaaatgattaaaactgtgataacacggttttgaatcggttttttattagaatggtgtgtgctgcaacggcacaattaggttgacgtgatacttgacgaagcacaggtgaaacatcctgcactaaatgcagatcagaaaattatttaccgcgttaaaaaaagcagatcaaggtatacgtagtcgttgcccaggtgaagatgctttcaaaaaaacaaatgggtaaaaagcatgcgatcatttaactgatacttgaatactatgggctaaggcttaaatgagattaaaatcgagctgatgaacgtattagctaacttttaacaatttaaagatgactgaccaataaaaatagttataaatgattataagtggatagatattatagtatattagttttaacgttgtgagccttttcgttatcaaagctcaaaatttaaaaaatttttttacaaaaatagaataaatatcggttgttattattagcttttaaaaccagttatccgtataattgacactaggttaagggggagatcccgccgatttctatgttgatatgtaagaaggaacactggggagtgataagtgtgcgaaaggagcagcaaacgctacggattttgggggataaagtccgctactatcgtaagttgaaaggcctatctcaggcggaactggcagcaaatatctgtacgcaagctaccattagcctcattgagaagcggaacaaagtaccaagcatgaatattctgatgcggcttattagtcgactaggtattcaactcgatgatattgtcgttgagcatcatgatcgggctcaacaaatgcttaatgcgattgattatcagattcaccatcaccaatatgcaatcgctgcagacaatctgagcaaaattcggttcgaaaagattaagaatgaagacgatcagaaacggtattactactaccaaggtattgttgagttattcaagaacaatgcccctgatgaatccatctacttttttggtcgggtcttaagcccgcttgttaattcggagcgggatttatacggtattctagccacgcttggcttaggcttagcatatgcggacaagcatacctttgatcgttcgcgggtctatattgatcaagcgctacgaatgttgaagcatgtaccattgtccgatagcaaatatctcgatattgagttgacgatttattggcatattgcccgcgtttactatgagttaagtgacttcaaggccgttttgaagtatgccgatcatgggattcgcgaagcagttaagcacgataaactgtttttgcttgacgaactgtttaccctaaaagctcgtgccatgaaactactgggcgatccacaggcagataagatttaccaaatcgcgattgcctttgctgaagtcagcggttcaacaacattagctgctgggttaagtgcagagatggcagcgcagaagcccaatattgaaactgcataatccggttatgcggtgatgtttaaaaatacctgagatagtcgtcttgcagcatcgttgctgcagctgacgacattctcaggtattttttggtgcgatccggcatctttgccgaggcgcaagatggcgtgattaacttacaaaagtagttcgttctcgattaaaccatttatatgatgaagtcgttgatttaactaatcatttggttcgtgtggggtaggcttttttgtacttgctagagccggcttgtttgataaatcggtccgaaccaccaggacgtcgcataaggcgtttcgggtgacatattcggttaccgaaccaataagcagacgttcaacggcatttaaccctgtagccccaatcataatgagatcaatattcttagctttggggatgtcgcgggcgatgattgtttttggcgcgccgtactcaatactgaaactgactttttctagtcccgcttttttggcctgatcgacgtaaccttccatggtggtcttggcattttccgtaacttgttcaaccattgcggaatcaaaactcgaaacattttgaaacgctcgggtatcaacaatatgaatgagaattagttctgcttgatttcgttttgcaacggcaactgcttttttgaacgctagctcggcttcatatgagccatcgatcgcaaccaaaatatgttgatattgttgtaacattcctcatcacctctaccttcattgtacttgattccatcatgaaattaaatgaaaagcgtttcacaacttgatctgggtaagactgataaaaatgaaaatggtggccagaaaagccccactgaccagaatcaccagatttgcccaagttgggaaggctaatcctccaataatggcaaagacaccgaccaccgtaaaaagaaccgtaaagatcttcaaaaaacgggtaagggctggggctggttttttgatcattaaaaagttttggttgcggtgacgccatgtataggcggctaaggcaaatacgaaaagcgcatagatgctcattaaaatgagtgtcacgggtaaaatccctcctagctgtttggttctattatgccacagtgagtgggagtgctggtggagatttttgtggtggagtgtttgggtgggggtggttaagttctgatacatgagagccggtttcgctcataacgcgttcaccggcgcaggagtctgcgtgtaaggacctgaggcgcagtggtcaagtgcggtcatcacgcctcaggccgcttaagttctggtttacgcccataacgcgttcgccagcccagaaacctgcacataaggaccttgaacgcaatgaccaaaacccggtcatcacgtctgaagccgcttgtgctctggtttacgcccataacgcgctccccggcgcagaaacctgcgtgtaaggacctcagacgcaatggccaaagcccggccatcacgtctgaggccacttacactccggtttctaaccgcgccggctcgcgctcaccacaaaaaaagccggcgcttggccggccaaaaacatgattggtttttatgaaagactaactggtgccgttttcttcccggatcgttgaaacccgctgctagctatgtgggcccagacgccaaggacattagccgctaagtgaaatagcagcaccgtcaatgactcttccggtcccaaggtctcgatactgttcggtcaactgatagttaaggaagcgcgaacaccttagaactttcaccgttatagtagcacgagaacgaccattcgtgcaagcgcaaccgctttcgttactttttcttcacctttttggcttcgtgttgccagcttttaagttgttgctgacgttgggcaagtgcagcttcatagcgacccgttgtcttgggttgatagtattgtttatttttgaggttatctggcaggtattgttgtgccacccagccgttggggtaattgtgaggcaacttgtagccttggccgtgtcccagttgtttggccccgcgatagtgtgcatcgcgtaagtcatcaggaatctgaccagcttgtccactttcaacgtcagctagtgccgcatcgattgctttgatgccagagttgctttttggtgccagacaaagatcaataacggcatcggccagtggaatccgtccttctggtagacccaggcgttccgcactttgaatcgcggttagtgttcgactggccgtggttgggttggctaaaccgatgtcttcatacgcaatgactaatagccgacgcgtaatgctatttaaatcaccgatcgcaattaaacgtgccagatagtgcaacgcggcgttaacatcagaaccgcggatcgatttttgaaaagccgagatgatgtcataatgggcgtcaccatttgtatcaccggaaatagccggtttttgaaggctttgctgaatggttgttaaatctattatgatcgtgccgtcacttttagcaggcgtagagagtaccgcaagctctagaccgtttagtgccgcccgcaaatcgccattggtggtgtgggtcaggtaatcgcgtgcttctggcgttaagtcaacctgatacttacctagtccgcgtttgtcgtctgcaagggcgcggtcaatggcggttgaaatgtcagtcggggttaatggcttgacctgaaaaatctgagttctgctgcgaatggccggttggatgttcatatacggattttcggtcgtggccccaatgagaacgatgcgcccactttctaatagtggtaatagaaaatcctgcttggttttgtccaatcggtggatttcatcaagcaacagaatcacggttccgctcatcttggcttcttcggcaacgatttgtagatcctttttggtatcggtagcggcatttaagattcgaaacgcatattttgtgctgccggcaatggcactggcaatactcgtcttaccagtaccgggcggaccataaagaatcatagaactcaaacggtgcgcactaaccatgcggcgaataattcgtccgggaccaacaagctcttgttgaccgacaacttcatctagattttgaggacgcatgcgaaaagcaagcggttgttgcaaaaagatccctcctaaaaagtgagcgtggaccagcgcggttagaagtcggagtgtaagtggcctcagccgtgatggcccggttttggccattgcggctgaggtccttacacgcagacttctgcgctggggaacgcgttaaagaaagtgagcgtgagccggcgcggttagaagtcggagtgtaagcggcctcaagcctaaatggccgggctttggccatttaggcttgaggtcttacacgtagattgctgcgactgcgagcgcgttaaagaaagtgagcgtggaccagcgcggttagaagtcggaatgtaagtggcctcagccgtgatggcccggttttggccattgcggctgaggtccttacacgcagacttctgcgctggggaacgcgttaaagaaagtgagcgtgagccgagtctacgtcgacgatcacctcatacgatcacctgacacattaaaaaatcatattttaaaattcggctgcttgcagttctaacagtcaaaaaatgctgtaacccttacaagcatgctgttaaacctgccggctgcgtgttaatctaattttaaatcatcaattaaaggaatgacacattgtgaatcattattggcaactgattcaaaaagaacatttgtttggtttggccgcccagacgcgaatgggtgtgattcgaactgtcaaacccattctgccggcagaaaccaacttaccgcagtggccgcaacgtagccgccatgctttggttcagccactttctgcttcagtgttgcaaatcgtaaccccattactagacgattttcctgccgttattgaccagttacgggctgggctaagtcgaatttgggcggcattaccggaagcagggcacttatcggcttttaccgcggaaaaagtgaaccagcaaacggtccggatagttttaccggaaacactatttgaacggttgtacacagcagagaattttcagggccatggtccggaatatgttgcctatcgtaatgaagtttatcagttggtagcagacgggttaacgcggcagttgccattgttgacttacttgttttctgcttctccagctaacggtcaccgcgcatttttgccgtcaccggatcaggaacggcaactggttcaaaaagtgacggatccagaccacttggatcgaattcttgcgctggacgttttggtggagcttgatccgtacgctgctagcgggatcacgacccaaatgctgacattcttgcgtgatagctgctggtttgcgctaagtcaaccggccattccggttgcagcggcaagtgaagtacgccggcatgctgtcatgcaggcgcggacaattgcccagatggcacctgatgccaaagtcgccgagctgccggcaatgctggatgcgatggcgacatggttaaatcatgttggcattgatgtgcaacaaaaacaagcttttgaattgatgcagacgcgattagtgaagccggaaacgagccttgccagtcaagttcttgcaacgtttcatgaccaaacagctgcggatgcgtcattgagtcggcaagcacaggcggacttaaccagtaccaatgagttgccggggatgacagatttatcggaaaacacccaggcattgttacaagctgctatggatggggggtatcagttcacgatactggatcggcaacagaacctggtgcaaattgccacggatacccagacacaagtcattgcagacggcgttgttaccaagtataagccagccaatgccatgatcgttgccactcatcggcacacagccaaacagttgctggccgcagcaggaataccagttgcacgtggggctaagtttactaaatggccggatgccaaagcagcttttgagcacagctttgcgcataaaagtattgtggtgaaacccgaggcacgcagccaaggcgaagcggttgagcagttttcgataccaccgactgaaaagcagtttgaccgagcctttcatgaagccaatcgccatcatggggtgctcattgaaatgatggcacgcggcacgacctaccattttaccatcatcgggcaacaagtgctcagcgtcttggaaaccgcagcagctaatgttgtaggcgatgggcgcaaagccattaaggaattgatcgccttgaaaaatggtcaccgcgcgacttcccggcaattgcagcttgatgctagcgcgcgccgtcagttaaaggcacaagcgttgacacctgagactgtgcttcaacgcgggcagcaggttttcttaaccactgccgcgcatccgcaaaccggtggcgatttgtatgacgtgacggacgagattgatgacagttacaagcaactggcgctaaaagctgccgccacacttgatttgccggtagcagctgtcgacattgtgattgataatctgtatgcaccatatgatccggaggcagatgggcaggcgaacgtaattagtgtcaatccggtaccggatctcgctgcgcctttgcatccggacatgggcgaatcacgcgcacttgccccggcattgctaaactggctgtttgctgtgagataagtaaacgaggtcatattaaaaccgacctcagcgtggtaaatttgcttgaaggtcggttgggtgacaccgttcatgatcatgcttctgcgcgttacggtcacgatgctgacatttaggtgcggtcacactccattatatttgttaagttgcgccaaacgtctttagcggttgcttaaataagttaaaaccactttttcttaggcttttcttgcgtgtcgtcaagtggcggcaaggtgatgttagcctgattgatggcagtggctgccacaataagcagccctggcgcggtatcggcagtttgggccgtttcgttagcaaccaatgtaaatggcacattggcatcggtgaggagcttcatgtaaggaccggtaatggcattatcaagtttgccgttgagtagggctttatagttgcggtcatggaaatcttttaataatggggcaacctgatgctgtcgtttgggatcagtcagttcctgattgctgatacataaagcgacccgttcacgtaatgagcccatgtacttgcggcgttcgtcgggtttggtttgcggtgcgccgtatagtgcactgttgagatgttcctgcatattgtcttctgccatgatgaaaagcctccttatgattggtttgatcaaataacaatttaacgatccttggtgaaccgtcttgttgtgtgaacgcgagtcgtaatgttgaaacctgacaacgcgttgcaatatgacctcattgtaacatgttctagtgtaaagaaaggaatgacgaaagggtgtttaccagtgacgactttgcagtttttgctgcgccaacgctgagtgcgcgaatggccttgattcggcaacagttggatccgaagtttacgcaagccgcgcagagcattgtgccattgttgcagacgccgaaccaaccaatctttgcccatattgcccaacatcggcgtcggcataagaacccgccgccaaacacctgggtagccttctccacgagtcgccgcggctataaaatgttgccacatctggcgttaggtttttgggatgatcgcctgtttttgtggctgtcctgtttgcgcgaaagtaaacctgtactgaacgatttttcaggtatcactggtgttatttcgacattacctgacagttggttactggctagtgagcatacagctaaggcaaccgtgccgttaaccgctgcgtcattggcacagacgattgaacgatttgagaccgtaaaaagtgcggaatttctggttggctgggtttatttggcaagcgacccgcttttgcaaacgcctgataagctatggttggacatacaacagcgggtgcgaaccttagcgccggtatttgcgcggttagttcaaaatactgccgctgtccggtaagcataactacttgtcatgatttcgattcttgatgtgatttcaaaaaaagctgataaaaacttagcagtgaaaacatcagggtggtaaaatcacactgattaaggaacgggttgtcggcttgaacgattgaaaacttcgacttcggtcatctaaaggagaaaactatgccagatgtacgttttcacagcgtctttgatattattggaccggttatggtggggccaagtagctcacatacagccggggcagcgcggattggtaaagtagtgcgcgacatttttggcgaaaccccggagacgattacgatttacctttatgaatcatttgccaaaacctatcgcggtcatggtaccgatgtggcgctagtagcagggctgttggggatggcacctgatgatccgcggttgccggaatcgctgaagctggcctatgaccaaggcattaaagtgagttttgtgccgaaaagcgataaggttgatcatcctaacacggcacatattgttttgcaagccggtgatcaccggttagcggtcactggggtttccattggtggcgggaatattcagatcacggaaatcaatgggtttaagatatcgttgagcatgggtcagccgacttatatcaccattcatgacgatgtgccggggatgattgcgcaggtcaccaagattttctccgatcccggcattaatatcgggacaatgacggtgacccgcactgctaaaggggaacaggcaattatgatcattgaaacggatgattatcatgatgatattttggccaaattgaaattattaccgcatatgcgcaatgtcacttactttgagtgatgacgcgctaacaactggttacgaactggctaataaaggagcttatcatgttttataccgttaaagaacttgtagaacaaagtcatgccttctcctcggttgccgaactcatggtgcatacggaagtcgaaaactcaacgcggactgaagcacagatccgtcatttaatgagccgtaatctggaagtgatggaacgctcggttaaggaaggcattgccggggtcaaaagtgtcaccgggttaaccggcggcgaggccaaaaagctgaaccattatattgccgctgaccggttcatgagcggtaagccgatcatggaggctgttcgcaatgcagtggcagttaatgaagtgaacgctaaaatgggactgatttgtgcgacgccgactgcgggatcggcaggagttctggccggtgttttgttggcgatgcgtgatcgcctgcatctgacgcatgatcagcagcttgattttctttttaccgctggcgcgtttggcttggtcattgcaaataatgccgggattgccggagcagaaggcgggtgccaggaagaagttggctcggccagtgcgatggctgcggcggcgttggtttgtgctaatggcggcagtgccgaacaggcagccaccgtcgttgcgattacgttgcaaaacatgctggggttggtttgtgacccagttgccggcttggtggaggttccgtgtgtgaagcgaaatgcactgggagcaagtcaagccatgatttccgctgatatggcattggccggttgcatcagtgtgattccggccgatgaggtgattgaagcggttaaccgcgtcggcatgcagttgccagcaacattgcgggaaaccggtgagggcggcctagcaacgacaccaactggcttacggctgaaagaacaaatcttcggcaaaaagtaattgtgattcaatgacggcacgaaaaatttttgcccggcatgagttttatttaaacggcgttactggcaacaaggcatttggaaagggtcaatcgtgattaatttatatattattcgacatggtgaaacagcaggtaatgtgcgccgcttaattcaaggcgtgacgaattcacacttgaatgcgcgcgggcgtaaacaggcgtttgctttaggcgttggtttgcgcacgaacggtttgaaggtagagcgtgtagtggcaagtgatctcattcgcgcgcaggaaaccgcccagcagatcttattagggatgcaaaaaaagttgccagttgaaactgacagcggtctacgtgaacaaaatgatggcatttttgaaggccgtgaactggaagacgtttcccagaaagtttttcaggttccggattatcatcagctggtcaccagtggcaaagtgccgattgaagcgattgcggacgggtttcatgccgccgataccacgaatcaggcggaagacagtcaacaagttattgcgcgctatgattttgccttgcgtcggattgttgcagcggcggaaacagccggtcagtccaatatactcgtcgtgagtcacggcacggctagcttgttatggttacgtgcacatggaggcgttttgcccaatcgaaccgaactaaccaatgccagtgttagcaaggtgacctaccaagatggccggtttaaagttgcctggctggataatacgagttttcgcgatcagggtttgaaggaagtctggacccacgatgcttgaaaagaaacgtctgcttagtcacatcatcaagtaggcgttttttttgcgcctgtgagtgctggtgaacggagaatcaagtcattttttgcaggtgccctgttattttcgaaaagattgtgcactatctaaatcagccgtgcgcgcgtatacttaaggtgaattttgaagtggaggcggtggatgatgaagctgacagtcgaagcttatcttgccaagttgaccaatttactattagcgccaggcacgcgtgcgtttgagcgccaacagttagtgcgggccaaacagcaggtggaaggcggcgcttctgtcggggcgagctgggatcaactaaaagcaagcttgcgacccttggcgattcgcgataacctgacgccggatgtagccgatttttatcgggcgcagacaggtgattctgaaggtgcgcaaacaacggatattagtgcacattttcagcatgatctggcttatcaggagcgggccatttttgctggtggctgtttctggtgcatggttgagccatttgttgatcagcccggtattcaatcagtcatttctggttacacaggtggggacgtacccaatccgacatatgagcaagtcatcagtgaccagactggccatgtcgaagcagtggagattattttcgatacgcggcggattcactatcaggaattggttgacttgtattttcaattaacggatccaaccgatgcattggggcaatttcaagatcgcggtggtcattatcgtcctgtcattttcgttgccggaccgagccaacgtcaaattgctgaagccgctaaagctaaggtggcggcttccgggcgttatgtgcggccgattgtgacggccattgaacctgctgccactttctggcctgcagaaaattatcatcaggacttttacaaaaagaatccgcaacgttaccggttggttgaaaaaacccgccagcaatttcttaagtttcagcatgcgcaaggtgatttgcgggtgttgctgaaacgccgtaaagctaagtagcttggccgaggggatgatgacatgcaaaaacctaaacgtcattggagcgagcgtgatatgcctaatcttgcgggtaaggttgtcgtggtgaccggtggaacaagcggggttggcctagccatgagcgccgcgttattgcgacatggcgcggcggtgacgattgtaggtaaaaataaatccaaaggcgagctggcggttgttaagttaaagcagcagacgaagcggcaagccattaccttcatggccgcggatcttagtgagcaacaggcagttaaccggctggcaaatcgccttttgcaggtgctgccgcgtttagatattttgatcaataatgccggggttatgatgccggctaagcgaatcgtgacggctgacggcgttgaattgacgtgggcggtgaactatttttccggatttatgctcacgttgcggctggcggggctactagaaaaggcaccgtcagctcgggtggttaatgttgcgtcaattgcaatgggcaacccgcagctgacgtttaaccagtttgacgggcgcaactatcgcccatggcatttttatatcacgtccaaattggctcaagctatgatggcggtcaaactcaaccaactttttaaagcagccggacacgcggtcatggtgaatgcgtccagcccgggactggcggcaaccagtcttaaggtgattcaatcgaaagcaacggcctggcccatgcgactggccgcactgagttttcgggtgctgccttggatgcgccaatccccgcagcaagcagcattacccgcactctacgccgcaactgcacctcaagcagaaggcggggttatctatgccccggcattatggcacggtctgcgcgggtatcccggcttatcggcatggaatcagcgaccagaacttcatgatcaggctttgttggatcgtctttatcgtgcttcacgccaggtgacgggtatttagtctgtcttcgaaatgttcaaccagatgctggggctatgtttttcacaacaatcctgatttaatcaccatgaaaagggtttccaaaattagtacatgttgtggtggccttccctattaccaccaatatattgtatattcaagacttacatttcagattttcttgcggcataataaaaacggtcgttgtcgtacaacgaaaactgaaacttaagggagtcttgttttgtgcaaacgtctgggaattattttagttggttgctgcatcagttaaaaggatggccgcaacagaattattatttattttggtttgcctttgggtgtcagctgatgacgttggtggatgcaaaaattactgctgttaccgtcattacttttatcggcacaaccttaggggtactttgtgtgctggcaattaacgcgaccaaggctgtcaatggctggcttgggttgctgagtgcggcctgctttatttttgttggttataccgcccgcaattacctttccatgttcgaacagattgcttacgtggttaccctggatctgccggtgttaattagtgtgcggacttggaatgacgataccaagaaccatctgaagactttcaacttgcagaaatgggtgttgtccattggcttcaccttggtggtttgggcagtcagtgcgtacttaatcggtcaattcacgaatgatcctcgcccagtttatgatggtatggcatttgcaatttcgttaacaggcggcattgtttgcttcttgcggtacaacaatcaatatttctggtggttgttcagcgggattgcacagcttattttgtgggctgtcacctttgcgcaaggcgatgcgagcttggcaatggcgatcaactccagcatttatgtcatcaatgatatccttgcgttcactgtgagtccttggttcaatcgtgggcgtaagcaacttggtttaaagacactttaaatagcacttttgctattgatgtggtaatgttttaatttgttgtaacctaattaagctaattgaggagcgagatttgtgatctacattctgggcagtattggtgcaggaaaaacgtctttgacaaaagttttgtcagcggatatggaagcacctgcgtattatgaagatgttgaaggtaatgggatgattgccaatatgctgcagaagttctatggtgccggcgctgacagtcgtaaacgaaccggggccatgttgcagattgcatttttgaccttccgttatcagcaattgaaaaaagccgtgacgcaggagaatgcgatcatggattcgtcactggaatcagactttgtgatggcgtcacaattgcataaacatggcgaaatcgatgacattgattacaacgtctatgtcacgttgtctcaggaaatgcaaagtaacgtcaatggcagtccatggaacgggttgccggatttagccgtttatctcaaaatcgatccggatcatgaactcgatgaaattcaaagtcgcggccgggatatggaagacattcgccaaaagccggaattggtcgcatattatcgacgtgtcaatgctgcctatcaagattgggcaaaaggttacacgcgctcatccatgattaccattgaccgtgatcggtatgatttcatgcattctgcagcagatcgggcgacagtgcttgatcagatcgagtctaagctagttgatctaggcaagctatcaccccagacttttgaggcgttacaagccaaacatgcagccggtccaatttcgaagtttgcataattttgatggttgccaccaaaaaaggttccaagtagctatcctgattggcaggatcgttaacttagaacctttttgtttgccgctcatcactaggatttaaaaacagggtaccaaaattacacattgaaaagctgaatcggtgcgttttaaggttttgcaatcattaccgcgtgtctatgctatgattaaatcaaaatgtgagtaggcgtcatccatggcgttttggcttagatgtggtgaactattgaaggaggaaaccattcgtgacgatttatgatcagcatatgcatacactgtattcatttgattctgaagcccagttgcgggattatttagcgcagactcaggcacctgttgtcaccactgagcatcttgaatttgataatcctgatgatggcgggcgtgatgatctgccggattacgccgggatgaaacgaacacaagccgctcttgctagtcactatcaaaacgaaatgttacttgggatagaggcaggctactttgcgccggcagaggaacgattacgcgattatctggccaaccacgactttgatttgacgctgttgagttttcatcatgatgggcagcatgattacctagatgcgcagctggctggattaccggcaaaacagcaactggaagattactttacgcggatgctggctggactcaaacagtttcacgatgcggatgttcttgctcattttgattatggcttgcggctctttgatatcacaccggagcagttggaagcatggggaaagccactgctggatcagatctttgccattgcagtcgcgcatgatcttgcattggagttaaacaccaagtcgatgtatcgctggcacaatgcgcctttgtatgaccaagccatcgcctggtatcagcaggcaggcggccatttgtttacgattggcagtgatgctcatgaaggtccgcattatgaagccaactttaaacaggcactggccatgttaaagcggcacggcgtcaaagaaattgcaacctatcgtcgtcatcatcggacaatggtgccaattgagccgcctgtggttgatgcagataatgtttattgaaattagcgcactaaaaagccgtttccgcagatgatgagcggaaacggctttcgtttacttcaaataagcattgacaaagttgaaactgttacccgggctggtttttagatcgtgcatttttggattaaccatccgcgcggcaacgagttgataaagcggaatcgcgccggcttgattgaccagtagttgttcggcttgcgtcatgtctttaaaccgcgccgttggattgttggcatcagcaccattggccttggccatgagctggtcgtaatcgctattttgccattgaccgtggttgtactcactggtgctggtgaacagatccagatacgtattcggatcagggtaatctgcgccccaagtacttagcaccatgtcaaaatcacgcgtcgatgctcgctgttggcgattcttggccggcacgctggcaatgctgatcttcaggccaggcagattttcctgaagcgttccttgaagatactcttgggttgccttgactgcatcaacgtcatcaccgagaagctcaacattaacattcttaatgccgagttccctaagcccttgattccagagcgtttgggcctttttcttgttatatgtggtgattgtttttgtgcccttaccaacggcagtggcaaaatcggttgagctgtcaggcaattggctcaagtcggctggggtgatgccgcgtgcaacgattgagccgtcagcaagaacatttttaacaaaagaatcgcgattaatggccattgaaattgcttgacgaatcttcgtgtttttaaacgcgggtactttgttttcgtttagttccaggaaatacgtgcgggcgcgtttggtggcgacataaccggtcttacctttttgttgtgcggcaagttggccggttaacgtggcatcatccagtttgccggtgtggtaaaggtcgagtgccgtattggtgtctttgaccacttgaacatcgatttgagtcaggtgaacattcttttgattccaataacggttgtttttgacctcggtccacttgtcgccggtaccggtccaacctttggatttaaaggcaccgtttgaaagcgtgtattcggacttggtgccgtatttgttgccccattcctgcacttttttagcgggttgcgggaagaaggcgacattgtttagcaggctgttgaaatagggaatcggatgttccaacgtgacttccagcgtcttgctgttgattgctttgacgccaagggtcgcggccggttttttaccagcgcggatgtcgtcagcgttcttgatcccggaatacatattggcctgggatgacttagtggccgggttgaccgtccgctgccaggcgaaaacgaaatcctgtgccgtgaccggagtgccgtcactccacttagcatcgcgtaacgtaaaagtataagtaagcccattgttagttggcttcacaatcttagttgccattgccggctgtagtttatgcccgtaatacttgtacaggccattcatggtatcaataatcgcctggccggaaacgccttccgatgccttacttggatcaagcgtttgcagcacatctgattccatgcggtgccagacctgttgtttgctcgaattggaactcgattgtttgccttgctgaccgcatgcagctagaacaattgtgagtgctgccgtgatcataacgagccatttatgttgtgttttcaagtcttgcccctccagttaatagactgttaatagaataacaatctccttacaaaaagcaagcgttttagctcgaaaaaacctcgtattcagccgccctaaagtgggtctcggataaggagtatcgcggggtttagtgtgctggcagcttatcagtccgaaatatcaatttaacggtgaatgagtcgtcatgggcctcaagcttcatttttccgcccattgtagtcgtcagcgattggacgatgcttaaacccaaaccgacactttgcgtggtgcgcgccgcatcggtggtgtagaagcgatcgactaattgatcaacatgcgaaaccggttgtgccgtgtcatttgagaaggtcatgaccaagtgatggctatcttggcgggcaaaagaaagcttggcctgacttttggcatatttaagccagttgccaattaaattctgaataatccggcgcatgagggtttcatcggtttcaagcattaattgatcggtgatggcaggtgtcacttttaatccgctggcagtaagctggtcatagtaatcaaagagttcgtttttaagtaattccgaaacgttaacggattgatggttcaaactgcgggtcttttcctgaatcaggttgaagtccatcagataatgcagatagtagttgactgaacgcaggttgttggcaatccgggcgagggaaggcttgggatcggcttcaggttgacggtcaagtagttgaacataaccggttgccactgtgagcggggttttgatatcgtgcgtcagatccatgagcatttggtgaatctttttttcctgttcaacttgttcgatttgaagttgatgcatcgtattgagattttgattgatgcccgcgctaagtttgcgaatcaaaggtaggttcgtgttacttgtgatccctgcattggtgttatggtgattaatataatcaagatcacggctgatgcgatgaacatcggttatcaccagtaatagcaaggcaaagagtactagacagatcacgataagtaagataaggatgccaagcataatgatttctccttgctaaatcaaacgtacaccgatgccccagattgaaatgatgtatttgggatcatgggcaagttcattgatttttgtccgtaagttgctgatgtgaacgtttaaggtattgtcggcatttaaaaacggctcaccccatacatgttcataaagttggcttttatcaaagacttgatggggatcacgcatcattagcgccaacatgtcatattcttttttaggcagcgttagggtttgctgattaacggtcaccacatggcgcttagggtctaattgaatttcgccgacttttagttgatcgttcgtcgttaccggttggccgctgacttggcgcagttggacttgaatgcgtgctagtaattcgtcaatgtcaaacggtttggtcaaataatcgtttgcgccttgctgcaacagggcaacggttttgactttttcctgaatcgccgttaacaccagcacgggaacttgggatgttttacgaatggttgttaaaacactttcaccggtcacgttgggcagcattaaatcgagaatgatcaagtccggttgttctcgatgaaaggccgttaaagcctgaatgccgtcataagcctgggtgaccgtataagtcggggttagcacatcttttaataaggcctggatatcctgatgatcttcaacaattaatatcttcgccatcagcgtcactcctttcctccaatgatagtgtaagctattaatgcaccttttcacaatttaggattaattaaggattgattatgctggtaattaaggaatgatcgctatgctggttttgtaaagcaaaataatggaggtaaggacgatggatgaaccggttttaacgattgatcaggtcagtaaacaattcggtcattttcaggcactggatcaagtgagttttacggttgaacgtggtgatatttatggcttaattggcgaaaacggggcgggaaaaacgaccttgatgcggctgattaccggcttatccccaatgcaggcaggcacgattacactgctgggggagcgggccggtcattaccagcgcgctttaagtcgagtaggggcgattattgaaagcccggcagcgtttgaaaaattaaccgtcactcagaacttgcgactttgcgccattcagcatggcatcaatgatcaacaggtcattgcagagacgattgattttgtggggcttcaggaaaagcgaaccaccaaagttaagcacctttcacttggtcagcgacaacgattggggctggcattagcaattttgccacggccggattttttgattttagatgagccgatcaacggtttggatccggccgggattatggaatttcgaagattacttaagttattaaatgaagaacgcaagacgacgattttgatttcgagtcatattttgagtgaactttatcaagtatccacccggtttggcatcattcaccatggtcaaatgatcaagcaattaagcaaggcggaattggatcaggctaatcaatcaggactggccattaccgtggaccgggcgacggtggccgcacaggtattggatcagcacggttatcagccgtttgatgtacttgacgaccagcatctgttattacgccaaaaagatgtcgatgcggccgcggtcaatcaattactggtgaccagtggggtgagtgttcaagacgtcagccaccaagccggttcattggagcaattttacatgcgcttgctggggcagactgaaaaacaggagggacaggcatgatgaatcaaattcgcgccgatttctatcgccaacgccgtacactaggcatgtatgtcatcgttcttatcaccatcgcctatgctgtttggtctgttacaagcaagaatatcggcggtgtgacagtacatggggatgacaatcttattgctcaaattgctgcaaaaacgtggacggctcagtttggcgtgcaggccgccaatatgtcggacacgctcttactttatttctttatcggggtctttgtgattgtttttggctatgagtttagccagaaggtttacaagaatacgctgatttcagggatttcgcgcctccaatttgttctggcgaaatacttagtgatgttgcttgacttacttatcttatttaccgttaactttggtattgcgctgcttggcggtttagcgaaggggcgcgcattaggtgtcagctggccaagtgttttgaatactatgggtttaagtattgttgcagccacctttttcctgagtgtcatctttagtctgggcgtctttttattaatcgcgactggctcgatgacaattgccacgattgtcgtggttatttttccgattctcgtaggggtgatccatctaattggagagtggtcatggttgaagtatattgatttcttggcagtttcccagaacttgggcgttggtagcatggaaatgagcgagttgccgccgtatattgcagttagcctcggatttttgattgtgatgatcggttcgtcagcatggcttttgcagaaaaaagagttataacctgagtcactttcaatcatagcttgaataaacaaccagcagaaacgtctcttcagtcggcgcatctgctggttgtttgcgttaatcttcaagtggcgggtgacgggttttgttgctgaaagatcgtcagaaacttttgcgcggttcgcgacatgggcgcatggcgggtccagatcaacgtcatacgggtcgtgagtttaggtgaaaatgggataaatgataaggccatttcccggttatcgagtaaatgatcaaggcccacagtgtaacctaagccaaggtttgtcagtattccggcattgtaggctaaattgaagcgggcaacgatttgcgcggggtcaaaattggaaccggcccatttttcaaacaaggtgacaactggttgtcgttctgaaatgatgagtggttgatggcggatcatttttggcgtgacagccgcgaatttagccaacggatcggttttaggaaccactaatccccagatgttttcaccggaaatcggtgtataggcatatttataagtatcggccggatcaatcacaacgccaaagtcgagtaagccatggtcaagttgttcggtgatttcggccgcattaccactgtagatttttaatttaacatcaggaaatgtggtcaccaaggccttggccgcatgcagaacactgcgattaagcctggattcacccagaccaatggctaagctgccgttaatggcttggtcatcagtcatatcggtgatagcagcgtctgtcaggttaaggatttggcgcgcccggttgacgagataagtgccattagcagttaagctgatcgcccgatttttccgattaaaaagtttggtgccaagttcacgctctagttcctgcatttggcgcgacaaggcaggttgggagatgtgaatcttattggcagcagccgtgatcgtgcctgcgtcggcaattgctaccagataacgtaacgtgcgtaattccaaggccaaggctcctaatcataataaaaatgcataatgatacatactatataagtattatacatttttcagttgctgacgcataatgaactcaatgacgaaagaaggtagatcgtgtgactaaagagaatgatcatgcgggtcttttcggactaggccaagctaacaccgcttatcaacaatattttaaaggccagagctatttgcattcacttgtaggcgcggaaaatgaaattgatgtccatgtcgccaatgtgacgtttgaacctgggtgccgcaataactggcacattcatcatcacggatttcaaatcttgctggtaacaagtggtgaaggctggtaccaagaagcaggcaagccggcacaaaagttacgtccaggcgatgttgtcacgattcacgaaggtatcaaacattggcacggggccacaaaagatcattggatgagccatattgcaattacgaaaggaaccagcgaatggcttgaacctgtcagtgatgaagcatatgcagcattaacggaggttgactaattgatgaagaaacaaacagcaggaagaaaacagttaggcgattttgccccgcaattcgccgcactaaatgatgatgtcttgttcggcgaagtctgggccaaagaaaacgagttatcggcgcgtgatcgcagtttgatcaccatcgcctgtctcatgacgagcggcgatttcccccagttaaaagcacacctgaaaatgggtaaagatcatggcttgacgaaagaggaagttgtagcaaccatcacgcatttggcattttacgcaggatggcccaaggcgtggtcggcaatgggtttggctaaagaagtgtatggcaaatgagcggatgcggcaccatttgagtatttagaaagtgttgcgtgtgaagggcaaatcgcaccgtttggcaatgtggtcactggtcatcggatgcaagaggttgctgattttatcaagggttataacgctgctaaagtagaattaactgaacatatgaaagattaatattgagcgcctgtggggattgtcaaagaagttgatgatctaaccacgggctttttattttacccgggtatgtatttttagatgatgatcaagtcagccctgaaaaatgtcaaccaccgttgtacggctatgcccacggtaagcaacttgcctcggtgaaaaaccggcatgagaattaaattagactaatgtatacttaagaagtaactgatacaaggtggaaagtcagcaaagggacgatggcatggtgttaaaagcggatttttttgattattatcactacaagaccgagctgactgcactttgtcgtgagtatcatttggctgcttccggtaccaaagcggaattgaatcagcggctaagggcggcaatgttaggtgagcctcctgagaccccaacgcgaacgagcggaccgacagccaaagttaatcttggtgcgatcacgctcacgacgccacttgccggatcgggtttcgcgtttaacgcggccgcacgttgcttttttgcggcgtattttaagacatctaagtttgcgttcaccaagccaatggcagttgtcaaacggcaagccgagtcgcggcctgagttaggattgacggtggccgatctagttgcggtttatcaagcgacccgaacaccatcggcgcgcaaacagtttcttgcccataatgtcgaggaacagacttacgagtggaatcgatttgtacgcgacttctttgctgatcatgctactgttgtctttagttctcgattaaaagttgcagcaattctctggaaaaacgtcaaaagatcaatgactcccaagcgttgtacacatcagttattgagccgatatcgtgaggaaatcgcacgatataaattataatttgcgagtccttttccggaagggacactcaatatgcggtgaaataccacgatagcttttcatgacctctttgattttcattttattttagttgaatattcagtataatcaaagccaagtaagcgtaccactttacaaatgctatgatcaaaagtctttgaacaaagcaattacttttgagtctttattactttatttataatgactggaggatgaaatgaaaatcaaatcaggcaccttggatcaagggtgggaactggtagaccgattagatcacgataatgtaaagtcgcaccctttttccgggaagggggctgacttgaccattaatctcattgctaaacaaggcgctcaagttattggcggcgtggcggcgagttcggatgattacgggatcggctatttggagatgctgtgggtcgatccaatgtttcgtcggcaaggaatcggccaggccttgctagtggcagtcgagcaggcgcttttcaaggcgggatgttgcaaagtcagattagaaacttttgattatcaggcgccggctttttatcgcgccaatcaatatcaagcgttcggcaagttgcattatacccatgcagcgttgaccgaatacttttttgtcaaaccattgcagttgcaagtatcaccagtattgccagcgatctatacgttagcctcaggggatgatgcagcgatgacttgggttgaagatcagtttgaggcagagaatttggcgaagaagccgcttttgcaggcaaaaccgggaatcacgttcacttttttggctgaagaagatggacagtgtgttggcggtattttcggctatagcgctatgtatcgaatcggctacattgaagcgttgtggatcgcaccggcgtatcggcgtaaaggacttggcacgcggctggtgaaccaactattggccgcgttcaaggaaattaattgtccaatcgtccatttagatacgttgtcattccaaggtccgcagttttatcctgcgctaggatttcaacaatttggaaccgttgattatcctgacaatggcgtgagtgaattgtttttcgtcaagttgatccaagattgaaaagagatgcagcatggtcagcagcaacagtatcatcgtcacacgtgaaaaagcgccagcaaaaaagcaggccattgtgcgcgaagttttagcagacttgcctgaatggtttgggctacccgcatcaacacaggaatatattgatgcggcggcagctttaccactatgggtcgctaaacaggatgatcaagtcattgggttcgttgattttgataaaacgagtcaagcaacaggtgagattaactgtatgggcgtcaagaaagcttaccaccacaagggagttggccggcaactatttcaggcgttggcggcctttgcgcggcaacatgcacattatctgcaggttaaaacggttgatgaaggtcattatccggaatatgatcgaacaattcgtttttatgaagcgatggggtttgagcgcttagaggtcttcccgcagttgtgggatgcctggaatccgtgtttggttttggttaaaaagttataaagatcgctatggttctgagaacacagtgtttgtgagtctcggagccatttttatttgtggaagactacaaataaaagtgataaacgtcatgaacctatttacatctagtttttaaaactatataatatagtcattaaagctgatggaggcgcaacatgaccgaaaaaattgcaattctcgttgattcaggttcggatgttcctaaaagtgtgctggatgcgaacccgaatatcgcggttgtcccattgaacattacgatgaacgggcataactatttggacgcggttgatattaccccggatgaattttattcggcattggcaacggctgaaaccttgccgaaaacatccagtccttcaccgcatgcagccaaagaagcgctggcagggctgtttgcggcgggttatacgcagattcttgggattacaatttcgagcgcgctgtcagtcacgcaccatgtctttcaactagcggcggaggagtttcccgacaagcagattaccattttggatacgaaaagcatcggcattggcagtggcattcaagttgcctatgcgacctcgctaatcaatgccggcgaatcgtttcagacgctggtggcaaaagttgaagcatcgatcgttaaaagtcggatctatttttacgtgccgacgctgaaatatttgagtgccgggggacgaattggtcgggttgccggattagtcggctcggtcttacatattaaaccggttatttcatgtgatccggaaggcgtttattatccaatctttaaagcccgctcggaggaaaaggcgcttcaaaaactggtcaatcagattgagcaggattgcaagaacagtgatcattatcgaatcggagtcgcgcacggccagaatccaacgctggtgaagaaactagccgcaaaaatagaagaagccacaggacacccggttgattttatcggtgaagtgtcaccatcgttgggagttcatactggaccggggttgattggtgctactgtacaatcgtattaagcgtctatgacgaatggttattttttgcgaatgttaaatgatgaccagtcattaaagttaaaactaattctttgcaaattaaagtcagatagattttcacacataaaggaaaatctatctgacttttcagcaattatcggaaaagattgaagatttatttttgatttaaccataaccgataaaaatgattaacatcgaaattctgcaaacccgaaacttgtgcatcgccaatttccataattgttaaatcaccattgatctttcgggcaaagtcgattgtgaaaaaagaagatttaatatcagcgccttgttttttaatgaattgctgatcgtttgcattcaagctttcaaaattcttcccccaataatcaataaccacaaatggatttctttgccaatagaaaacgtgatattcctcaaatgtcggattgtttgataagtaggtgcctgtctgaagtagcggaacaaactcacggatgacaagaccaccaacaaggttctcgccctgtcgagtaatgaagttatgaatcacttccaaagattgtgaaaagttttgagcatttggaatgtaaaaggcactataccattcgtgctttctgctcttaacaaaatcctttattgtgactggtccggaaaattggttaagcactcgtatgatacctttatcggataaatcggttgtccaagctgatttgagtgtgttagagtgatgggcccagctaggaagcaaatgggtccctgtataggcgtgggtatcagtaagcatttttgctccagaagctaagattaaactattcattttagaatatgtctctggccgtaacatccatccacgatagataactgttgtttcagaaggaaaagacgtattcaactcaagctgattttgatctaataagcaatcaagattaataagccgaacattagtcatggattttgcaaccgtatattcttcggcgtaatctgggtcgggttgagagactcttaagggatttcccggaaacaacaatgttagtttgctagtgtccatttttagaccccactttgaatgatggtgatgacctagaagaggtgtagccatagaatgagctttgaattagtttagccagctagttgaattttatcgaaacaacgccttcatgccaaccacttattccgtttcgccatctcaattgcctcaatccgattatgcacccctagcttactaaagatggccgacaagtagttacgcacggtgccttcagatagaaaaagcgaggctgcgatttgtttggaagacaaaccactggcgacttccccgagaacggccaattcgcgctctgtcagggggttgctttcagccgtgaccatgttcgcaactaattccggtgcgtaaactgtttgccccgtcatcactttccggataacggcgattaggtcatcgcttgggctgtctttcaaaagataaccgttcacttgagcagcaatagcgcgttgaaaatatactttttgggcgaaggtagtcaggataatgactttggtaggtaaagcgtgcgtgtgaatttgatcagcaacatccaggccggtcattttcggcatttcaatgtcgaggatcgcgacatcaggcggctgcgattgaatggcttgccaagcggtggcgccgtcttgtgcgctgccgatgacggttaaatcatcttccaagttgagtaactgcgaaagtgccgagtttaacatgctttgatcttcggcaaggtataacgtaatcatcatcaggcctcctttggcaaagtaagtgaaacccgtgtgccttggcgattatggacaatggaaaaagtgccgttgaccgcttgcatgcgttgttgcatgccgctaataccatttgacccagcgcgaacatagctttttgaatgaccgtcatcttgaacctcaaccagataagcggtaggggtttgatcgaaggtaatgatggcttggtgagcgtgcgcgtggcgaatcacattggtaatggcttcggaaatgacggcgctcaattgggcttgaacggttgtcggccattcagtggcttcattttccccgtttgtcagtaaaaccacatccgcttccgcgagatttttaccttgttccaacatcatttcgctgagggactgctgatgaaggtcgttgacaatggcgcgaaccaattgtaggttgtcgcggctggttttagcaatatcgtctaattcttgggccactcgttccggcgctttgatgagtaacttttttgccaattcggttttgagcgtgatcatcgagaagctttggccaagtgtgtcgtgcaagtcacgcgcgatgcgttcacgctcaccgcggcgaacaaccgcctgcagccgccgattggtttgacttaactggcggcgacggatgactgagcgcgcaagggtgtacgaaatcagcggtgaggctaatggaaaaacaaggtcgctaatattcgcattgtcgagaccaatgacgccaggatgaaactgattataacgccagagtccgatgaacataatcacgtaaaatgcggtggcaaaccagcgaaaatattttcgcggataccgggccaagataaatgaaatctgccatcctgggtaaataatcatgtagttattgaaggcaaagatcgaaaacaagccggcaatgaagagttctagtggaatcgtcaccgccagccaccgatcgatttcattaacgagaatataaacgaccaggaaaaggacccctaagccaatccacagccagtcaatactggacttggtggggatgaactcgctcataatatatggccaataaagcagccacacataactggtccattccagattgctgaaccataatcgaaaactatgcctcacccaatgccacgcctctccgttgttcgtttcgagtcattgccacaacgaccaagccggcaagtaagacccaaacaactatgccaatcaaattggttaagtctactttagcacgtgacgtcagttcatttaagagattgttgacgaaataagtcggcatcagcttgccaattgtttgaagccaacttggcaacatgctgatgggccaccataagccactgacaaaggccatcggaaaagtcagcaagttgctggcaagactgagcatttcttctcgatggatatgtgacagcgcaattccgatcatgagcaaaggcagctgtccgattaagaccacaactatcagccccaaccattgactgatttcaagccgaacgccattaaccccaactgcaatcccgcctagcaccacaactgacagcagactcatcatcaacatccaaaaggtgatggacgtgtaataaggtaaggtgccatgtggagaaagccgcaaaaaagttgtcaggcctttttcacggtcacgtcttaagatagaagcaatgctgaagaaagcctcaattaaaacactgtagacgatcatctggcccaggtaagtgagattgaattgcttgatttctgcagctgatccactcaccatgatcttagtgaagagtaaataaaatccagctggcatgatgattgaaaagaaaatgaatgaggcgtttcggacgactaatcgcttgccgtcaaaagctaattgtgcaaggaatgttttcattttatttagcctcctgttgggttaactgtaggaaaatatcttctagtgattcacgattcacactcacttggtgtaggcggtcaagcagcggtgtcaatgcgcgcagggtctggtcaccatctgtgctgtgaatgacgagtttatgcttgagatgatcaacgcgatcaactgcaggcaatccgttgaaaatgagtagttgcaggtcagtttcaaatgtaatggtggcacctagatgctgtttttgcagttgctggagggagccgtcaaatgtgaagcgacctttttgcagaatcagcaggcggtccgcaatttgttggatttcctcgagataatggctggtaatcacgatggttttaccttcttggcgcaattgctcgatgttgtcccagaatgctttacgcgagttggcatccatcccgacagtaggttcatcgaggaaaagtaagtccggttggttgattaaggcaacggcaaatgtcacccgacgcaattgcccaccggaaagactgccgagtcgctgtgttttaaaaggttctaagcgtaagtccgtgagcaatttattagtgtcaagcggatgatcgctttcagccgcagcaagcttcagtaaatctgcaatcgtgatgccgggaacaaccatgtcgccttgaagcatcgacccgatccgtgccttgctaatagccgatccgggctgctgttcaaaaacgctgaccgcgccttcacctttaagtagtcctagcaaaatgttcagcaaggtggttttacctgcgccgttaatgccgatcaaaccgatgatttcaccggcgtttaccgttaagttaatatcatttaaaacttgttttttaccatagctgaatttcagatgttcagttcgaataatggtgtgcatgtcatccacctccaacatcgatactatgcggccaccatgattgccagtagtcgcgattgtcatgaatgtgatgtgacaaatgtcatgactgacgattttggggggcgggagaagcgcgcggcctttgttggaatgacataaatcgttaaacgagtcatattaatgaggcagcagcatctctattgtgcgaaccgtacttcttgtataatggagggaatatggacgcggattaaaagaggggaatcaggaagatggcagcgacattatcggagcctttgcgtaatctattattagcaagtcaattaggactgagtgtgcatcatcctttagctggctggtcagtgctgacgattctttatcgcgatgccggcagcagcagtgaaccgatcaccttgagttatttagcccggaagtacaacaacgattatcttgatggcctcagtggggaaacgcccattgccgatgacgtcttgaaaaaggtgctcgatgtcctcgtgacgcaagcagggttagttgaagtaagcccgcgaaaagtacgcgcccgcatgcgcagcggtcagtaccatatccgccagtcatatgtttaccggatcacaagcagcggcattgaatacttgaaaatgatgcaaaaagtcatcgatgccgaaagtaccattacggccaacaccaatcggattcaggaatacgtggatctggtcgaaaaactgagtgtaccggttcgttcgggggccgacacccggctttacaatgattttaaaaatatgcttgatgcttatgacgatgtgatgaaaggcattcataaattagaagatgatcttgatgagattgcaaacgatattgcctttaaccatggaagtcaggctgcagcccacttgcagcaaatgttgcgccaagaagcgatcccggcataccggcaaatgttgaatcaggcagcacgtattcaaggtttggctgacgaccgtacttttcctgatcagattgcccattcccagcaggctaaaggggatctggatgctgctcacgctgtcggccgtcaagaagtgctagtcactcgctttcagcggaccaagcaatgggcacagtcgcagctcaatcggttatcgctaagtatgagtccaacgacgaccgcgattgatagtagtctcgattcgatttatcttgtctttaataccttgttaggcatcgtgcgtttacttagtcaggaatttgaacatgctaagcgccaaacgattgacttgaaagcactgtctaagaaaattgatgggttactcgcacattacgcccagctgacgattcctgcccagatcccacggcacttgccggcggatcgtgaagttgatgaccccaatgacttgctagatgcgtctacgatggggccagttcattatttagccaatcccattacaaagcagccggccagtgccgccgacaatccgaccgtcaccgatgatgcaccgagcgagcaggcccaactggcaggactgcgagaatttcggcggacgttgatggtggatgatttccatggccgggttgatcacaatttgacgctcaagacagttatcgcgcgcgatgaaatcgttaaactatttgctgccacctatcacaaagatcttgctgcttttgctccatttggtcgcgcaaccaaatcagtcgaagcattaccggattcgccgccgttacagctgcaagtggcaggcgaagattatgcagttgtgctgccgcatgggttcacgttttcgtttgattaaggagaagaaataagatggcgcaaataactaaacgcgatcaactggtgattaatgaattgttggatcacggggtgtttaccaccacgccgcttgctgccgccacgcaattgagtcgaggtgccattgcggatttaaagaaaccttccgtgcagaaacgaatcggattttactttaagaacatgttcggcatcacgcccgaaaactttcaagaaaatctgctttttctgttgggaaccgagaaactttcgccggtgcaggttcatgttcttttggcaacggttaaaacgatcattaatgagccggaattacagaataatcaagcggatcgggccattgccacccaaaaaatcatccggcaggtgcatagcgaggttacggagttagaggagcgggaattgttgcgtaccgttgatgcactgttcgtaaaacgattcgggttgttcaccccagatcgctttgaagacgattcggaaaatgtaccagcagagattgatgattattgggaggttcatccggatttcaatgaatttgcccaaaacttggtgaattatttggtcaatgtccagtcccaagaggaagtaagcgagattcaaaaagttaaccgtgttttactgacagaacaatttatgagtcctaaagccaatccgcaactttggtcaacgttggctgtcaacaagcaagagattgccgaacagtgggcgcaaggcgggcggtttgttttagaaatcggggatcgttatgcgctgctactggacacgcaacgccagcctagtgttgccaagccttatctagtcgctttggcagtggcccatcaacttggcgcaggggtggcggccgctgatttaaccgcactcattagaaaagtgacaggagaaatttttccgggatttaccattcaacccagccaggtaaaagcagcattattggagaatgatttgatggttaaccaagatgactactggctgccaacaccgattgtaggacgctttttagttactcaggaggaagatataaagggagatacggcatcatgacgcaaattttggtacctgtcagttaccatttacgcaactttaataaatacgccaaattagatatgcaagctgcaaaaaatggcaacctgactttaattggcgaaaacgcggtcggcaaaacgacactagccaactgcttcttcccgatgctcattgatggcgcgattacgacgccatcgttcaaccccgccaagaatacagaaaaagtgtcgcaaagtaccagtgcccgcaatagtagtcgggacacacggacgtttgaatcgatgctgcttggctgggggccgggcgcaatgaaagtacgaaccggctatagttatgtcttgttgcgttctgaccagcgccaggtattgcttggtttaggagccacccgcgtacaagacgatccccgcaaaccaacatggtggtttgtggtcatttcgaatgaaactcaaacaccaatagacttgcaaacgactgataataaaggaaaaagtttagacaagctcggttttaaggccgccaatgcagctctaggcgatcaattgcatgtttttgagcgccctgaagactaccgcgaatttgttgccactcgcgtttatggctttagcgatggcaaagtactgggccggttagccaatgcttatcggctattggcctcgccgactttgacttccgggaatgaaaagtttgcaccgatactggcagccttaaaagatgcacaagaaggcattgatccaatggtgattcgccgagttgctgacagtcagcgtcaagtcaatttttatcgcgggcttttgaagcgcatcggcgaagggcagcggcgattgaagcggatgaaatcacgaatcttttggcataatctgaaccatcttcaggagattctgctgacgccatacagtcgcttgtttgccagtaacactgccgatcgggagaatctgattcatactgagcaagaagtggcggcatataaagcgcagttaggggatctgaatcaggcattagcagaagtgacaacgctattagagcagttgcgcgacgaaaaagccgagcaggatcagctgatcaaacgccggacgcaatatgacgaacaaatcgcgacactccagggaaaactcgatgactatcaggcaactcaagccaagatcaagaagtatcaaaccaaattgaatgagctaatggcgcaacatgacgcgttaacgcagcaactaaacgcacatttacaaactcagttggcaccaattaaagtgcagttacttgcgcgcacgagtgaattaaatgatttctctaatgtgatgcaagctgatgcgtgggaagagatccagacccggctaagtcattaccttcatcagctgtcggccgccaaagtacaatatgatggccttgaagaaaccatgaatcgtctcagtgccgatatcgagatcaccaagcagatgcaaaccaagatgggcgatgcgatcgataatcgggtacaaggctttggcagtggccgagtgcatgatggtttgcaacaagacaaccaaacaattcacgaagccggtgcggcgcaaatgaataagcagtatcagccgctgcttgatcaacaaacggccattttggcaaagcatccggacctaaaagtgatactaaagaatgcgaccattttgccgcagctgacggcgattcaaaagcagctcaaaccgctgattaaaacgttaagtaagttgcagactgaactgcgcgcaaatgaaggacagcaatccgcgcaaaaagccaccttagacgcattaaacggaacgatcgatcctgaatttgatgccgcgggtttgcaagcaacgattacacgattgaaggcagagcgggctacgctgaaagttgatcccgacttacctaaacgtttgtcggcgactgctaccaaacaacagaaactgaatcaacaagtccaaagtgttgaatcggaaatcaatcagcgtcaagggacgatccatgttttaaccgcaaacatcaaaagcgccaccactcgccttgaagaatgggccgcggatggtgcttcgaagttgaagacgttaaaaccgtattttcccgaagacgttcggcttaaggatattgatgaattactggcttttgcgcatagtaaccgcagtcgcattcgcagcagtagttatgcagatatcagcgatcagatcgggcgcctgattcatcgccatgatggtcaaggggaagatcgaaacgcgctggatgtgctgtttgccgagcggggatttccagccgaggcaagcgctatgcggcagcaacgttcgattcctagcaacggcttgacggtggtggcatttgatatcaacgatgccatgcgtcttttgcgtgaagattacgctggcgttgaaaaagcgttagccgaagaaaaaagcggtaatgatatggcttataccacctttgtgcaagcagccgttgcagccattagtgctcagtatcatgtcatgacgacttagaatgaaatcctcgctcaaggcgccagtcatcagcacatcaagttgaaggtacgactcagcccagttgaaggcatcgccccggaagccattaccgaagcctgcgactctcagcggcaacagcggccacatttggaatcgttggttaaacagcgacttgaacagctggccaacaatactgaagtctccgacgatgatgatgctttctttgcagcagctgaaaacttacttgatacgcgtacatggtcagattttcaggtgttgattcggcgccgtcaaagtggtgaaaacgacttcgaagtggtggacgacaaattcgttcaatccggtggctccggcgcggaaaaggcgcaagcgatggtcttgccattgcttctagtgcccaagatggtgttacagcggtcaaaaatgcgtgacgccccgcatttggtgatgtttgatgagtttgcagataagttagatcctgaaaccgcaaaatcctttgcgaagaccattgtcaactttggtttcagttttattgcgactatgccaagcggggctcagaacaagcttttggccgatggggtggataatattgtctgggatgtcatgggctcgccacaacaaggcgatgggaagtttcatcttaatcgggtgcagcagaactttatttggaagaaggatacctgattccagattgatagggctattgccgagcgaggtaaaagcaagccaatactgaagtcatcactgtttttgagaataaattgacgtcatatcaatctgtagcctataatataggtgttgaaaagaggccaccggggggcctcccgatgacctcaacgcgtttcagatgacgaggggaaaagctagccgttttggttagcttttttgattatcgcgtacgctttcgcaatactggtaatcagtatgcttagcgcgatgataatcgacgccacatccaatgcggcgaccccctttcgtctcctgaacttggcatggccatcacctccgcgtttccagaatattgaggggtgtgagccatccaatccgctaggcaaagaagaaagggtaattggtcctttctcgatgcttggttatagtttatagatgttgaaataagaggtcaatcagtaaatcttttggcacaaaaaaggcttaaatacatacaacaacacagccgcaacctgcccaaagcaagataggtgttaccaaacaactttccaacaattgtttttcaaacgctgactgaaaaccggttttatcaaggaaaaaattttggtcagtgcgaaatgtatgaaggggtgacaaagtgagtcaatatattgaggcatttgaaaaggcaacgggacaatcagcgccagaccgggcagctaaacttgacgagttgtttaaccaaattaaacgcggtaaagccttgccgccgcggggacagcaggcagtcgccatgggactcacagcgcatacactcaacgatgctcgtgaagatccggcgctgtttgcctactatcggtgggtcatgacgcactgctttcagtctggacaggtcaatgaactaacagcgcggttgatcggcatggcgttcacgtctgcaaatgtttttgaaaccgacttaccccaacccttgacgttgaatccttggcaactcacaccgatgctcgactttccgttgaaaaacaaacaggcggtggtcatcgaaaataacggtgtgtttgcgttgcttcatcaggaacatccggactggccattgattttacagtccggcaatgacttcaatgacgtgtatgtgcgactcattcaaggactggaagaacgagggatgcgttatgcatatttaggcgacattgatagtgctggtatccgcatggccgaccgatttgccagtcttttgaagcaaacgtcagctgaggaggtagcagcattacagacgccaactgatgttcgagtatggttagcagatctagggaaaaagaatgcgaaacgtactaaacagctcaatgtgatgacgcgcgtgtatcaggatgagatgacaacgattgcactgtttggcaagttcattgagcaagaacagttggtgacgatttatgaaaagcggattgccgcatggcttaaggtgggaaaatagctggatacttgtgtggctacattttaaagaaaaaaattatctttcacaaaacaagtttgaccaatagaaaagggccgagttgtcacaagatcggtccttttgcaatgcctattttatacaaaaacgggcacagccaagtatatagtttgtgttaacaatgattgaaatgtttggagagatgaaactttgtgtgttgctgtagttcagcactgaggaggctttaggttctcatcgaccagtctctaagaaaagtcacgtgtggccaaatctctcactgaataattagagctattcatcaactgaaccttgatcgagctcaaagtcttctgaacagcggtggaagattcgtgaatttgaacaacaagatttctttttactacgttatttgtatcagaaacaagcctttgaagctggccaagagcaatttcggaatattggggatcatcggaaaggtccactagtgactgagaaatatttgtgagtaatttgttctcactgtctcttgagttgtgggtaatcaagaattgcaaaatttgcggtaaggtgttcctgagtttcgatctgcgaagagccaatggaacaaaattgactaataattcagaaacaaaaagaagatatcgcgggctggtgtcaagagtaagtgtcaaaagtaattttccagtgtctactcctaaaactgatatatcaacaaatgaacggatggcatcaattaaggatgtgggtgtgcttatctcaaagaaacctgaaggctcggcggtaatcttactggttcgaattttatcacttgtcttttcaaagtctttatagctatcattcgactgtgaaagcagagtcataagcagttcagttgccgactgctttgtactaataacttggtgaggattgttgagtgtgtcgacaatctgttcaaagacttgcccagtcatttggggattcagtcccgcatgcttttttattgaaatatttaatgtggcgaaggggtctgttgcgaacccgaaagttaatttaccatcttgcttatcgttttgtgatttcatttcggaaagttgatcttccaaaaaatcgttgtaaccagcatcttcctgattgttccaaatgaaaggagcaatttcgtgattgaagaacgtctcgtggtttttgatgaggaatttttttagctcccttgattcatttggccaagcagacaaaactgacaggattgcgagtcggattttgcctgtgaagcgtgtttgatccgaattttttacgatggtgaagagaactgcgatgacccgatgctgctgatcaatttgagcagcggtataatctattgcgccaaatatgatgtctgccaactcttcatagtagtgcttcaatgaaggaactaaagcttccaaaatagcgataatatcattttgcggaattctaaaactatttcgtaatagacccaaaatgtcagtgggagattgcctaatggaaacctttcgagtcgcccatacttttatttttttgtaaagaattgtccaagtatcattgaagcttttgtctgagagatagtcaccaacgaggcgtagtgaacttgcttctacacttagcttttcggcgtctacagggtatgattgggatgatttgataagagaaagtgcgtcctcttcagaaaattgtcccactagatagttataatgcgagatccagggggccatacccttataggaatctcccataagtagtttattttgtaacaagtcttgtaaatactctacattttgatatttccgcaatagcatttcagaaataatattgagattctttggtagttgccgaatctgtgtaattgatccgttgcatgcagcgactacaaatgcgtcagtgagtaaatctggatacactgcgataccagggccatatgaactttcctgtgtagaagaagcagttaaagttttgttctcttcttcccttacccaagaatagacgcgctcaagtgagtggtcaattcctgggtaaaagaaaggtttcgggaattcttcaagttgtttttaatatgggttttcgtcattcggcggattcttttcttcgacttcgatatttagtaagttgcggagggtcgatgagggtgtcttgtaacatccatgtggggacttcgttgatctctgcattccttagtagttctttgagcgtctttgaagcctcttttggtttagatgagaagaataagtagactgcttttaacttggcagtaagcactttctttaagggctcaggcaaagttgttttagggtttgcggactgaattcccaaaaacattaatttgtcccagttaaaaggtaacctcttgttgtagaaaatccgtaaaatcagattactaacgctttcatcaataggggagtctgccgcatctcgtttccttccaagggtatcgtgaaaaactcgggttcgaatcatctctttagaaagccctatctttttgaacatcgttttttcaaaaagaaatgatgtgtcagggacaaatgattcatcagaagaattgatcgtattgagttgttcttcgttaaaaataggggagttcttattgaaaaaagccttaaaagttgtaaccatctgattgaaaagaatgttctcaatctcgtcaaggtaatcttcacttcttggaagcacctgcacccagttgttttccccctgcgccagtaactgctgttgcatttttgaacctttgtcattcttggatggaagtatacaaaagagccttgggatttggtgatttctagctgccgtaatctctatctgcacaccggctggtatcggatactcagaatctaaaagtacaatcacaaggttggagtccacaagttgagttagatattcagtctctggttccagaattgaggaaatatcttgttctagaataaatggttcgatgaactggtatttagttaatcgatcatttagagaagtccgtaattcaagaatcctctttctctccggtttatcgggatttttcatggctgagctaataaatatacgaagtggacgcaatttctcttttctcattattctatcctttggcaggctacattatcattctatcgttggatttttaattgtatctatactgttaatgatcaatattcgatttttcctctatatcttatctaaatgcgagtttacgtattgtcaatggagacgttgaacatcggccaaggtatcttttgtctgaccagcatacatataaataatgttatccagaataagtacgctttttcggatttttgccggaatcgtcaacgatttcgtctttgtgaaaatattttgcacgagtttgatttaatcaatcaggtaattaattgaactcaggcttttcttttaactgttattgttataattagaggctattaaaccttgacttgctttgagccctttaaacgcgtttttaaaaatgcataatcgtatcttaagatggagtaaacgatcagcactcctcccgagacacacgtttgttcggtcttaccaattcttatctgcaaagaactttgagttatcttttgatcttttctcaatcgcctgaccttcatgcccaccttgatctcgattgctttttcttcgttcacatcgatctttaatttcacccgtctgaaaactgtaataatctcagcagctctttgcaatatagacttttggtcttattgatgataattgaaacattgatagtgtttctcgtcaagcataacaagtttagtctgaaaatcggctggaaattcaataaaaataataattttttgatttttcacgaatcttaaaactcaccatacattcgacaagttgtcttggcttgtatggcgccaattaaaaaccgccgcgcgtaaacccgactgttttatctcgctcactgggttgctataatgatatttgctgagtaactagtggctggtgatttaggttgcggtttctggccgaatttcagtcactttatagttgatttgataatgcaggccaccctgttcgaccacaatagaaattggtacagaaaaaagcttaaggaggaggtcgatatttgccaatgcaatcgcgctatccaccgttaccaccaaggactcagccgttctggtgttcactaagtcaagcccaagtgaacctttcaagaaggcaaacttgcgctcaatggcaccccgacgattttccgcactgacatcggctttgcgctgtttcggatccacatgtttgggctttcgacccagctttggcccattaagtttaatgcctagcttcttacacagattgatgttatctcgcgtgcgatagagagtatcgaccagcacctcatccggatattcacccactaggtcaaaagcatggtcaagcgttacttcaagatcagtgctttcgttaaatgaattgaagtcgaaacgctctacatcaatcacgccatccaacatggaacagtcaatcttggcgccaaactcaacggactgctttgccttacctcgcacgattggccggatatacggctgttgaaggctaacgatgcgattctcgacatggtgagtgtggttctcaaacatgaagagctgctgctcatagacttgtttaatcacttccagacactgtgcttgccaatcagtgagctgaccgccttgcgcaagcagttccgccacatatcgcagatctcttcggatgtattgtagctgagcttgaagctgtttgcggcgttccttgttttgacgccgcggtttcctcgaaaaagcggtccacttaccttttgcttcacgtctgtatgtccgcggaatttccacacctaacccgtgggccagatctgtgaccatttgttcgagattcaaacgactctggttaagcagcgttgtatcttggggatacttgatcttgaccggaacggcagtcgcatcactaatcaaaacatgcgtcccctcaggtagatcggcctccaaccgctcgcgcgtgaagtcattagtaatgttgcggatcaaatctgagatggctgaaagccgttggcgaaagtgcaccaacgttgtgtgttcaaatggcttcttagcgcgatattcgggtaatccgatgaagtactgataggctggtgtatcacggatatcgtcgacaacttggcggtcggtcaggcctttcttcaacttgatcaacgttgcgccataaagcaatcgaaatggcttcgctgctcggccggtttttgaagggaactgtaattggtatgcctcttcaagtttggcccatgggatcaattctgcatattgaacccactcgttgtccgggctgagcggtgttcccagagcgcttccaaaggattcaagtgacagttgcgttgctttttgacgataaaccatgatcaattcctccgataggtcagcgataagtgcaagggtaaatcccaaagcataggcatttcgggcaaatgaggcttgcacttattatacgcttaactattggtaaagcctattatgaaaacacttttagagtttttcaccattcactaactaagcagactgaacagaaattgtggggaagatattttgattgaagaccaaaccattcaaatcgtacaacaagacttgacgggaatgacgagccggcaaatcagtacggttttgaatttgatgaatgaaggcaatacggttccgtttattgcgcggtatcgtaaagaaatgaccgggagtctggatgaagttcagattcaggcgattgaggaagcctataaacgggtgacggcgctgcaggatcgtaaagctgcggtgatcaagagtattgccgaacaaggggcgctgatgcctgagctggagcagcaaatccgtgctagtaccaagttgcaggatgttgaggatatttatttaccttataagcagaagcgtcagaccaaggcaaccattgctaaagcgcgcggacttgaaccttttgcgcagtggattctttctttcccagtaggcgatttgacgtctgaagcggctaaatttgtgaatccggacaaagaggttgcgactgagcaggacgtattggacggtgcccatgaaattcttgcggagaagtttagcgaaatggcgccgatccgcaattgggtgcgcaatttcaccatgcgtaccggtacgattaaaacgaccgtcaaaaccaaaggcaaggaactggacgaaaaaggcgtttatcagcaattttacgactttgaagagaccgttaagaaaatgtcatcgactcggacgctggccattaatcgcggcgaaaaagagaagattttgacagttaaggttcaagttgaccccgcttcggtgatgcagtattgccattttaaattgattgataatcgcccaagtaccgaagcaacagcgtttattgaagcggcatatcaggatgcctacagacgcttcattggcccggcgattgaacgggaagtgcgcaatactttaaccgaaagtgctgaggagcagtcgattaaagtctttggtcagaatctgtacaacttgctgatgcaggcaccgattaaaggcaaggtggttctcggatttgatccggcttaccgcaccggctgcaagctagccgtggtggacgaaaatggtaagtttttggacaaagctgtcatttatccgcacaaaccggcgccagagaagaagcgtcaggccgcggcttcggaactgattgcgctactcgaaaaatatcatgtgacgatgattgcgatcggcaacggaacagcaggtcgggaatcggaacaatttgtggcggaaacgctcaagcagattaagcgggatatttattatgtcatcgtcaacgaagctggggcatcggtatattcagccagtcaagaggcgcgggatgagttcccggacctgcatgtcgaacagcgcagcgcaatcagcattgctcgccgcctgcaggatccactggcggaattagtgaagattgatccggaatcgattggtgtggggcagtatcagcacgatttacccgccaaggcgctggcaagtgaagtcgatgcagtcgtggaacgcgcggtcaatcaggttggcgttaacctgaacacagctagttaccaactgttaacccacatttccggattgtcaaaaacgattgcgactaacattgtgaaataccgcgatgaaaatggccgctataacagccgtgccgaattgaaaaaagtgccgcggctggggccaaaatcatttgaacagtcagttggttttctgcgaatcattggcggtaagcagccacttgataacaccgatattcacccggaaagttaccctgttgccaaaaagattctggctgcggcggggttatccacggctgatttaggtgatcatgaagtaattgccaaggttgctagtgttgatgtggccccatttgtcaacgatggtgttggcgttgagacagtgcatgacatcattagcagcctgcaaaatcccggtcgcgatcttcgtgagaacatggcagcaccgcttcttcggcaagatgtcctcaccatggaagacctgaagccgggcatgaagctggaaggaactgtccgcaatgttgtagatttcggcgcgtttgtcgacattggcgttaagcacgacggtttagttcatgtctctaaaatgacccgcaagtttgtccgcgatcctaaaacggttgtggcagtcggtgatattgtgacggtctggattgaatcggtggatctcaatcgcgagcggatacagctgacgatgatcgcgccgactgttggttaagcgtaaagacagttacaggtttaattatcgtaaaaaggcgttgccgttagatgctgggtattaaccaatatctaacagcaacgcctttttctaatggaacttgaattgtcgcaccggcaatggaagtacacttaaaaaattctaagacttacttttgcaaaaaactttgccgccattcgtttaattccgcagaatgcaagggcaaccggccatcatgatgacggagcggccagtaacgagggtcatcatagttcgtttttttgactgggatttcgcgttgcacccattcataaataggcttagtgttcacgcgtttctgcagccgattgattaaatcatcaagtaaatgaacccgctcgtaggcccaaattaatttcagcggctgggcagcctcgtgtaaatcatatctggcggcataatctgaaatgttccacgattcataaactcgccgatagcgattacttttaccgctaagtagatcgtcaagttcaccgcgctttatttttgctcgtaagctacgattggtgcgctgcttcattccttgatgccagtctttgacaacgggatattttttgaaacttcgactcatgatatgagcactcctttcagggtactcacaaatcgtggatgcgtttcataatgtcatctcctcaaacgttttcttgcaaatattgtactgaaatttaggcttaatgtcatttgtaagggtcgactttgatgtaaaattgcggttttgcgttcattttatgaaatcggtttccttcattggtggcagtctatcaaggattctgagacgtaaccgtatattaaaataatggttgaaattaattatagaaagattaaaatattagaatatctaaaaaaggagctgacagtatgcgaccaatcatcgcacttaccggagattcaatggtcgcgccttcgcctgtcattaatctgaactatgcagacatggcgccaaacatgatcaaaaatgcaattgtaaaagttggcggggcaccgttaattttgccgtatcctgaagatgacgctgcagcagcgtcgttggcagcacaatatgttgatgtttttgacggtttggttttgccaggcggaccggatgttgatccgacgttttatcaagaagaacccattcaagcgatggggcgggctacttatcaaaaggatcggttcgaaattgccttaattaaagcaactttgaaggcgaataaaccgatttttgcgatttgtcggggcattcagattcttaacgtggcattaggtggcaacctttatcaggatttgccaagccaaaacccgcaagccaccattcgccatgcccaagctgcaccgggacagtggccgacccatcacgttgcgattacgccgggctcccatttagcagcattgttagggacgagtagttatgttaactcccggcaccatcaggcagttaaggatgttgcagcgagtcttaaagtcactgccaaagcgccggatggagtcgttgaagccgttgaaagcaaggagtcgaatctgattctcggcgttcagtggcatccggaaaatatgtggcaacaatttccggaacaactaccattatttgccgatattgttaaacgtgcaggaggtgatggcaatgaataatgttgtgaagaaagaaaaaatgggttattggagcatgattttgctggggatcaacggcattatcggttccggaatttttctgttacccaatcaggctgctaagttaattgggtcagctagtatttttgtcttactttttgatgctttgttggtcatcagtattgcactttgttttgctcaagccgcgacctattttgatcgtgatggtggtccgtacttatatgccaaagatgcatttggcgattttgtcggctttgaggtcggctttgtcacttgggcgattcggattatcgcggaggccacgatggcggttgcttttacaactgcattagtcgggacttttccagcgttaaaccagcctattattcgcgattcgattatttcaatcatggtcatcggcttggcgctcatgaatatcgccggtgtccgggtttcaaccgtggtcaacaatgtgattagcgtttcaaaattggttccgctagttttgtttgttgcaattggcattttcttcatcaaaggcagcaatttcacgccattattcccaggcggcagctataagtccggtagtttcgggcaagccgcggtggtcatgttttatgctttcaccggttttgaaggcttagtcgttgcggcgggcgacatgaaaaatgccaagcgtaatttacccaaagccgttgctaccgtcatgacggtggttgcacttttttacatcctgattcaggttgtcagcaccggtattttgggaaacgcgttggcaagtacagatacaccaattcaaaccgctttcgctaaaatcaccggtggctttggcaatgctttggtggccgccgggacgctgttatcgactgggggactgcttgttgccagttcctttatcaccccgcggtctggagttgccctcgccgaaaatcacatgatgccgcaattgttggccaaacgtaatcgggtcaactcaccatatgttgcgatcatcgtgtccgcaaccattaccttactcattgcgtattccggcacattcggctacctcgctcaaatcagcgcggtttcaagatttgcccaatacattccaacatgtttggcggtgatcgtgtttgccaaaaccaagaccaaggataaaagcagtaccttccatctgccgcttggccccgtcattcctgcagtagcaattttagtcagcatctggctattggttcaggttcaggtaagtcagctggtcattggccttggcgcgttgctcgtggcggtaccgttttatttcttgacatacacgtaccggcagcatgggaaagcatgaagtttggaaaataaaatatattataaaaaccagttcaactgttatcggtagtcgaactgttttttgctttgaataggttacatttgaaaattgaaccaagcgtttaattaggttggacgttccgcttaatccaggagccgaacacctaacattccttttttatttactttagccgtatacgcaaggtgataaaccgcatcaccccgcagcatagcttcttgtatctgtttaagctctgcttcagctgcatgtctggtttgataccaaccaagctcaatgaggcgagtggtgccaagcaacccgcgctgactgctctcaccgattagaagaaaagtgggcgcggttttgctaggaataccttcagcaatttgaaaaccggtatagttgcctaaacggtcattgattagggaagttattgtgatggcgctacttggcctgttagcagctggtttcggttctggtggttcattaccaagcagatcagcgtaagagactcctagaatcatcgtgaactgctgaattttttgaaggtccggttcagccaagttgttttcgtactttgagattgcctgccgactaattcccatggcttcagctagttcattttgcgaaagtccactccttttgcgcaattgcatgagtcgttcaccgaacatcgtcatcgcctccttctatacctcaattatccgatagatgcttgacctatacaagcaatcaagggttgcgaagtgtcaactgggggttgcagaagggtgtaatcagtctgaatctttaaagttgtcttcgtttttcgctaaattgaaaagtggtagggaaaattttcgaactagattctcgtcatcaatgacggttgaagtatctcgattgtaataggggctattctcatccctgacggctgaaaaccaattaaaagagccgtttgccagaatatggccatctactacaacctgttttgagtgaactcgagacgaggcctcaaaaatgcttgcgccagatgctttcagcaatgcgataccgccttcaaagtttgccatcttttggttatctgtttgatcatacatggcgcgatttggatagatgttgacacgtacacctcggcgagtagcttgtttaatagcgctaagaagtgcgattgtgccagcctcaattgacctttttgatatataaggtgagctaatgtcaatttgcttttttgcggttaaaagttgatggtacagccatttgtcatgtgtcttggcgtcactaagaacgaactggcgatttgatttgatctcttcttcagtaaaaagcgttacatctttaatttcgttgctcgattcagaaaatagtcttcgggctaattgtgaagatggcttattgcccttagtggtaagtaaatcgatattgccgaaatataagaagctatcttttgctcgtgataccgcgacgttcagcatattgatgcccttatcaaagaaaaattcagtctttgcgttgtcataaacaggtgaaaatagaactactctccgttctgcaccttgcatcgcatgaaccgttccgacaatgattttttgatcatctaattcatatcgggttaaggcttcattgatttctttggcttgtcgattgaatggtgataatattgcaactgtatctccaagtttccaatccttaacattttttccttccaagttacgaaggcttgctttccgatttttaagccattgagcaatggcatcggcttctcgacggttgtaacggctgccattttggatagccgacagtccgaatacatgcgcatagcccagttgtggcagctggtctgacgaggtgatagtagggttagaacgtttaggaattagtttaccttgataagctagtgtattgaagtaatcagtaattttgggtaaacaacgaaaatgttcttgtagtaaaagaccgccaccgactatttcgctctgtgtaaacacactttgatgttgtgccacactcataaggttgcccgaggatgttgcaaatcccgtctttttgatagcagctatttcatcttctgaaaatttggtcagacttcgcatgttggcttcgtcaacggatttctggacgctccatatcggttcaatttgcttaacgtcgccaactgccagaaaacgttttgcaagtgcgagacttgcaattgccagttcaggactaacttgaccagcctcatcggcaatcaacaaatcaatgccattaaggaagggaacatgatcttttcggaaaaaggcgtctacctgataaaaggtgccaacaaaacaaggtgtcagcattgcgcgaacttgccaaactttccgtactttttcaaatgcggcggttgctgagttagtttgatgctgcttcatttctgttaaccagcgagcctcccaataatgggtagctagcaagaacgctaagtaacgtaaatttgtatccacttgcttattaagatctgaacgtgattgcgtatttgttgatgtcaatttgatgttattctgagcgcaggctatcttaaaattctcttgacgtttctgaacatcaattagagccagttttgtagtgtttatagtcttacttaaagcagtattttcagctcgaacatgatcaaggtttcgttgaagatcggtatcatctgaaaaacccttcaagtgcaaataatcaatttttcttgcggcttttcttttaggaccaatcaacggaaaataatcaagaatgcttgcatgtttagcgtcaaagtcataccaaccacgaagctgcctttcagcttcgtcaacacttgcctggcttttggttaattggattgtttgctcggaaagtgttgcggaaagtgttgctgcctgtttgtcgaaattaacgtcctgaccattgataatggttcgaatgtcttctacaacgttggttagataaccatgaagcgtttcacgacatttttgaagtgagccacctgaatccggaaaaagtgcatgataattttgaaaaaatacttttgtagccttgcttagcgcgtcatcagtaattagctggtcaaagtattcgttatgattgatggaaatcgcagcatatggaagtgtcccgtccgtcaagtttctatttgctgcaagatataaaccataggtgttatgtccaggtagccaatgtgaaataagtgttgactttttcactgacattttttgataaatagcctttttgggaagtgaaaatgccgcaacctcttcatcatttagttcaccagcttgaaagctttgaataatatttgtaacggcttggttgttaacagatgaagcgacacaaatgggaggcatggtctctttaaacgccgcttgaacccattgcgtggccacaacactttgaatcaaagtcgtcttacccgtgcctgggggaccgctgacagccaatgtttgtccgttagttgtagcatcaaggttggccaatgcatttcgttgggtatccgtcatgccatgcttgggactcatttgagcgaggtgattagagtaatgagatctcatgctagcttgggatagaatcttttcatcttgaacgctggattcaggatttaaagaatcgaaaagaggaagttgctctttagaggccagaatgtcttgataaaggccttggatttgagctgaaaatcctaaattttgctcgccaggaatgatatggcagatacctgttggttcggcaggtaggacataattgttcactttttctattgatttaaatgtggcaaatgacaagttggtcaagtgttgaaagagagcctctgcttgatgaatgtaatcagaccactctaaatgatcaagagcaccaccattgattgcatcaaaatagtcgttgacatttgcaattggtttatagcgtagtggatgggaggaatcttcgccagctggggtcattaattcacgttgaatccacggaaccgtatattcctgatgagttagttgaccatcttcatttaacattgctggaataatgaaaggataaatgaagaccttcgcagttttgatcacaatcggcataatgaaaacacttaagccgtttgacgactcggtttttgcaaggcccttccgcgtacgtttgaaaaaatctggaaatgtagggctcaaaattttgccctcaacaatttcgctatagttggtcgaaaagggtttagtatacttggcgttaacctcgacaagactgctttgacgcaaactttgtagatagtagttggcaatttctttggttgaaatcatattaagtcctccaaattggtataggcgttattaggctatctacctatacaaaagcttggctaccgttagtatacatttttgggggaaataagatagaaaattgtctgcaaattctgtgcaaagtctgtaaacagttcaagagctcaaacaaaaacagccaactccgcaaagagttgactgtagctgtgaagtattaaagtttctggttatagtattcaacaaccagtgattcgtcaacttctggttcgagttcgccacgttctggcaagcgaacaagggaaccttccttcttattgtcgtcaaaggttacgtaagctggacgggaaactgtgttctcgatagcttcattgacaacagcgaggttttgtgagcgttcgcgaagaccgatcacttggccaggctgtacttcataggaaggaatatcaaggcgcttgccatcaactgtgatgtggccgtggttgacaagttggcgcgcttgcggacggctggaagccaagcccaaacggaaaaccaagttatctaaacgggtttcaagcaggatcatgaagttatcaccatgggtaccttctttgatcttaccagcgcgcaggaacaagttctggaattggcgttcgtttaaaccgtacatccaacgcagcttctgcttttcacgcagttgctgaccgtattcggaaatcttacggcggttgttggcaccgtgatcaccgggtgcataaggacgacgagctaattctttaccagtgccggaaagggacaagccgagacgacggctttgcttccagcgaggacctgtataacgagacatatgagtattcctccaagtttttatttggagtaaaataacgaattgcggctttagcacacgggcagtcctgcaaaggttcaccttcgcagccgcggttactactgtcatcggcgtgatgccgaggcaggactggagccgaccatgccggccgctgctgcattattttacacgcgagctagtataccgtgtttagcgcagcggtgtcaaggtgattggcgagcgtttgaccgaactgtgtcaggatctgttcgtcgttttcgctaaaacggttgagtttcggggagtcaatgtccatgatggcaacggtttcgccattaacgttgatcggcacgacgatttcggcgttgctggctgaatcgcaggcgatgtgaccggcaaattcatggacgttagcaacgcgaatcacgctattttgccgatagctggttccaacgacgcctttgcccggttgaatgtgcatgcaggcaacttttccttggaaggggccgaggtcgagctgcccggttttgccattataaaggtagaaaccagcccagttgagctcaggcatgctgtcatttagcagtgcactggcattggcaagtacggtgatggggttggtttcgcctgtaagtaggccatcaagttgatcgataataataggatcaagggttgtcatttgatcagtccttttaggaatttatgaaaagcagcatctaggccttttaactgcgggctttttttgcgatactggtagctaggatgttatcgtttttaacacttaacggcattttagccggtaagtaggcaaaatgcaattagaaagataatcggtaaagcagagggtgtagggatgatctggttcttcattattgttgcgattataattgtggctgctggcagtgtctggtggctgcagcattattttcaaacgcgtatcaaagacttagacgaaaaagtcgaagcgattgatattggtgcgctctcgagtcagattcgcagcattgagcaactgaagctgaccggtgacagtctggcaacctttggcaagtgggagcgggcgtttgatcagttaaacgaccacgatctagctgagctgcaaaagattctgcttgatctcgaagaccaggttaaacgcttccgtttagatcgggcatcgaaaattgcgaaggtgctggaagataaaatcgagacggctcagcgccaatacgaactgattagccaggcactacaagacattcggcacgacgaagcagataaccgtagtaaaatgttgcaattgcgagatgattaccaggtttcacgcaagacgattcttgccaagagctttgtcttcggtgatgctcagccagcattagagcaacaattgcagcaattggcgcagctttttcaaaaaattgaccagatcaataatgatggcgatcatcaggcggcaaaggcagaaattaaacagttagccgagcagatgcgggttttgaagaagcaggttaaggaattaccaccactggtaaacgagcaggtcaacgagtttcctggacaaattaacgaaattcagcacggttaccggcaactcaccaccgcccattatgtgttcaccgatgatattccggggatggttgcggatgtcgaggccaagatgaaggatgccaatgcggctcttaaatcgattgatgtggaggcaacagaggcagccaatgcggaaatcgaagctgagatcgataaaatgtacgccattatggaaaaagagatgcaggccaagaaacgggtggatgttgcgtcccctgatttgcggcgcttcattgatcatgcactgcgccaaaatcgggaattgcaggcagaattggatcatctgaatcaaagctacacgctgaatcatcatgaaatcaaaaccgctaaaaatttaaaaatgcagttagatgcgattgacgcaaattacacgaaggataccgatgcgattgaagcaggcgaggccgtgtactcggacgtgattgcgcggtttgatgaaaccaaagaacagttaacggcgattgaaaagcaacaggtccagattaaccaagacgtggcaggtttgaaaaaaggcgagatcatcgctaataaacaagcagagagttttgaactcgatatgcggaatattaagcatgaaatcgtccgccatcacttgccggggttgccgcaagactatgtgaataaggttaaacatgttactgccgaaattgatcagcttaatcacgatttggatcaggttaaaattaacatggatgcgattgccaagtttctgattaagattgccagtgatattgatgatttaaagaaaacaaccagtgccttaattgatgcggccggattaaccgaagaattgatgcaatatgccaaccgctacaaaataacggttaagccggtggcggacgcggttaagcatgcgaccgagctgtatatgcaatttgactatcagcaggctgccgatacgttggcgaccgcgttggagcagacggagcagggcagctacaagaaagttgaagatgcttatcttgcgcggaagaaagcttcattatattaatttgcgtgattggaaagccagccggggtttgggctggcttttggtttggggtggaggttgtgatgtgtgcagggatctgtaggggggaattgcagacttaaatgggcaataatcattcagtagggtatacgtctccgaaacgcgttcaccggcgcagagatctgcgtgtaaggacctcgaacctaaatggccaaagcccagccatttaggttcgaggccacttacactccgatctctaaccgcgccggttcacgctcttgaaacttactaactttttgtctataattcaatccagtcgaattaacggaaggggccggctgatgatttattttgataatagtgcaacgacgaagatttcgcctgatgcgttggcgacttataacaaggtcagcacggatttttttggtaatcccagcagtttgcatgctctgggaactaaagcaaatgaggttttgcagagttcgcgagcccagattgctaaattaatcggtgctaagccggacgagatttattttacgagcggtggaactgaaggcgataactgggtgattaaaggcactgccatggctaagcgcgaatttggccgtcatctgattacgaccagtatcgagcatccggctgtgatcaatacgatgaaacagctagagaaactgggatttgaagtgacttatttgccggttgatcggcgcggttttattcatattgacgatttgaaagcggctattcgcaaagatacgattttggtgtcgattatggcggttaataatgaaattggcagtatgcagccgattgttcaggccgcgcgggtgttggataattatccgaatattcattttcatgttgatgctgtacaagccgttggtaagggcttggatgcagcgttgcaggatccgcggattgattttctcagtttttccggccataagtttcatgctccccgcggtaccggctttatctatgccaaagagggtcgcatgcttgatccgttgctaaccggtggcggtcaggaacatgattggcgctcaggcacggaaaatgttccggcgattgcggcaatggccaagtcgctgcgcttacttttggctaatgaagatgctaacgtggctcggcagcaagcagttcgcaagcggatttttgaacatgtcagccaaaagcccaaggtgacgatgtttagtcagttaacaccggattttgccccacatgttttatgttttgccattgctggtgtccgcggcgaaacgattgttcatgcgtttgaggatcatcagatttacatttccacaaccagtgcctgctcaagtaagaaaggcacggaaagcagtaccttggccgccatgcatacggacccgaaaattgccacttccgcgattcgggtgagtttggatgaatctaatactttggatgaagcggatgcgtttaatgcagcgtttgatacgatttatgcaaagtttgccaagcttgataaagcgaccgtctaaacgagcatcagccattgccagtgcgaggagtggcagggtgtcagttatagcggctgatactgccaacttgtttttacgcatcaccggtttttactggatcgggtaccgcctacatgaaaggattttaagatgcaatattcagaaattatggttcgttacggcgagctttcgaccaaggggaaaaatcggcaagcgtttatcggtcgtttgaacggtaacgttacacaagcgctgcatgaattccccaatctcaccattcggcctaaacgtgatcggatgcacattgaattgaatggcgagcctagtgatcaggtgatggcacgactgtcacaggtattcggcatccagaatttttcaccaagtattgccgtagaaaaggatatggcaaaagtccacgaggttgcgttgcagctgatgaatgaaacggcaccgcacggcattagctataaggttaatacgcggcggagcgatcatgactttgccttggataccaatgctgtgaatcttgatttaggcgatttcttgacggataagcggccggacttagttgtcaagatgcatcatcctgatatgattttgcgagttgaagtccgccgtgaagcgatttatttatctactaaaacgattcaaggcgctggcggattgccggttggaacagcagggcgcgcggccttgatgcttagtggcgggattgattcgccggtcgcaggctactatgcgttaaaacgtggcgtggacattgaaatggtgcactttttcagcccgccttatactagtcaacaggcgctgaataaagctaaacaactcacggccaagctgaccccttatgttggccggatttactttattgaagtgccatttaccgagattcaggaggctgtcaaagcaacggttccggaaggttatctgatgaccgtgcaacgccgaatgatgttgcgattgaccgaagcgatagccaaacaacgtggcgatctggctatctttaatggtgagtcagtcggccaggtggcttcacagacgctggaatcaatggcagcaatcaatgatgtcaccacgatgccgattattcgtccggttgcgaccatggataagaatgagattattgccgaggcagaaaagatcgacacgtatgatttatcgatcatgccgtttgaagactgttgtaccatttttgccccgccgtctcctaaaaccaaaccaaagacggatcgcgcacggtattacgaaagcaaacttgatgtcgatggtttgatggcgcgcgcgttggccgggatcaaggttcaggagatcaagtcatctgatcagttcctgaatcaggatcaggatgttatcgcagaattgctttaaaaattgaataaaagcggtagttgctgataagttatttgcttatcggtaactaccgcttttttagtttagcgttaaaagtcggcgaatgatcttaaaaaagaaataattcacaagatttcgcgatattaataagttgctggatcgaataccatcatggttgcccgaaaaatggttgtcacctgcagaagacgcattgtgcttaattcctggtttgaaaagatcgttaatataaaatggctcagtaaaaacagtggtaaaagagcgcgcaatttgttaaactaaatatgtgaaaatggtaacaaacacgtgcggaggtgttgatggtggtcgtcagtaaacaagcgttatcacaggcaacgattaagcgaatcccggtttattatcgaaccgtcaaagatttgcaacaggcgggggttaagcgggttcggtctgatcggctaagtaagctggttcatatcgcgccagcaaccattcggcgggatttttccaattttggcgatttagggcgtagcggctatggctattcggttgatttacttgcgcaggtgtttggcgagttattagaagtgcactcggaagaacagatgttactggtggggtgtggcaacctcggacgggcgttgttgaccaataattttcgccggaatccggatctaaccattgtgatgggattcgacacggatccgcagctcattgggacgacaattgccggggtgccgatttttgatctcacaactttagcccaaaatattcgcccggggatgcatactgccattgtctgtgtgccgagttccgcccagaccagcgttattaaccaacttgaggctaatggcataaccgctattttaacctttgcccctaagccggtcccggcaaaaccgacaaccacgattcgctacattgacctgacaagtgagctacaggcgttattgtttgttgatcatcaaaaacaggttgcgcgacaggtgacggagccgttgcgctagtgttgcttggtgagctggatcacgctcgttataacgtgtttacctgcccagaaacttgcatataaggaccttggcgcaaatccgtttttacgcccataacgcgctccccggcgcagggacctgcctgtaaggaccttggtcgcaagtccgcctttacgcccataacgcgttcaccggcgcagaagtctgcgtgtaaggaccttggacgcaatggccaagcccgggccatcacgaccaaggccacttacactccgacttctaaccgcgccggttcacgctcactcacattgaccctgtcatgatcacgggttataatgcagctaatgcaatgatcaagagggttgcggtcttttttttcagcgacgggatggttggtgtgaatctcgaaagaagggcgtgattgtagcttgtgagctgccgtcctgaagtgagtagggaacggccggtgacagccgttatcctgaaccaagtggggattgattcccaatttaggtggtaccgcgagtagactcgtcctaataatcgatattagggcgtttttttgtgtatacgcacggcgcgacccagctttcgggctggcgtgcgggtgatgcatcagcgcgtgccaattctagaaaccggatggacgaaaaaattttgtgaggtggagccagtgagtgatgaaacgttagcaccaaagtatgatcataaagcagtcgaagaaggccggtatcaagaatggcttgatgaagatgtcttcaaaccaagtggtgataagaaggctaagccgtattcaatcgtgattccgccgccgaatgtcaccggtaagttacacatggggcatgcatgggatacgacgcttcaagacatcgtgatccgccaaaagcgtatgcaggggtttgataccttgtggctgccagggatggatcatgccggaatcgccacgcaggctaaagttgaggccaagttgcgcaaagaaggcatcagccgctatgacctaggccgtgaaaagtttgtccaaaaagtctgggaatggaaggacgaatttgccaagaccattcatggacaatgggccaaaatgggcttgtcactggattatagtcgggaacgctttactttggataagggcctgaatcaagcggttcgacgggtgtttgttgacctttataaccaaggcttgatttatcgcggtgaatatatcgttaactgggatccgcaagcgcgcacggcactatcggatattgaagtcattcataaagacgataaaggtgctttttaccatgtgaaatatccgttcgcagacggtagcggctacattgagattgcaacgacgcgtccggaaaccatgatgggtgatactgcggtggcggttcacccaggtgatgagcggtataaagatatggtgggcaaggaacttattttgccattagccaatcgcaaaatcccgatcattgaagatgcttacgttgaccctgagtttgggactggggcggttaaaatcacgccagcccatgaccctaacgactttcaggtgggcaatcgtcatgatttgaaacgaattaacactatgaatgacgatggcacgatgaacgaaaatgccggcaaatatcaaggaatggatcgctttgaagcccgtaaagctatggtggccgatttggataaggccggtttgttgcttaaagttgaaccgattgtgcatagtgtcggccatagcgaacgtacgggcgttcaagttgaagcacggttgtcaacacaatggtttgtcaagatgaaaccattagctgaagcggcaatcaaagcgcagcaagagccggacaagaaagtgacatttgttcctgagcggtttgaacatacctacttgcagtggatggaaaatattcatgactgggttatttcgcggcagttgtggtggggccatcaaattccggcttggtacaacaagcagaccggtgagacctatgtcgggatggaagcgccaaaagacattgaaaactggaagcaggatcctgacgtgctggatacctggttttcaagtgcattgtggccattttccacgatggggtggccgaataccgatgcgccggattacaagcgttattacccaacagataccttagtgactggctacgatatcattccattctgggttgcgcggatgattttccaagggttgcattttactcatcaacggccgttccagtacaccttgattcacgggttaatgcgcgatgaacaaggccggaagatgagtaagtcactgggtaatgggattgacccaatggatgtgattgaaaaatacggcgccgatgccttgcggtggttcctgattactggtaataaaccgggacaggatacacggtttagttataaacaggttgaagcagcctggaatttcatcaataagatttggaacatttcccgatttgtgatgatgaacttaggcgacttggatacgccgcaacagccagatccaagtacctttgatttgtccgataagtggctttttgcgcaattgaacgaaaccattaaacaagtaacggatttgtcagcgcggtttgaatttggtgaaatgggtcgaaccctgtataacttcacctggaatgttttcgcggactggtacgttgaaatgagtaaggaagtactttacggcgatgatgagcaggccaaagcagccaagcgcgtcaaccttgcttatgcactggatcaaattttacggctattgcacccagtgatgccgtttgtgacggaaaaactatggttggcgttaccgcatacaggcaaatcaattgtgacggcgagctatccggtggcaaacgctgcctttgaaaatgctgacgctaccagtgcaatggatgcgatcattgcgctcatccgcggcgttcgcggtattcgtaaagaggccggcgctccgcttaagaccaaagtcgatattatcgttaaattgacggatcctgctttgaagccaatctttgaacagaactttgactttatcgatcgcttcgtcaatagtaaagccttcacggttggaaccgatgtggccgagcctaaaatggcgggcagtgcggtgatcacaggcgccaccattttcgtaccgctcaatgaattaattgatttggacgaggaaaaggccaaactgactaaagatgctaagaagcttgagcaagaaattgcccgaattgacaagaagctcaataaccaaggcttcttatccaaagcaccggaagcggttgttgcagaacaacgcactaagcgcagtgattttgaagatcagctaacgagcactaagcaacggttggaacaattacaacaagcttaagttaccaagtggctttaagcgattttatgatgaaaaaaccggtattagggttgagttttaagccctagtaccggcttttttgatggtcgtggttgaagcatgccgcaagcaagcaatctggcgcgcggccgtttgttcgatgggttctggcagcaataaaaacgtgaatttgactggctaagctcataagttgggcccatttttctggtatgatgaagctatatatcgcagcagtatgaaagctggctgcctaaatgataaaaataaggaaagttaacaatgaattacacagaaagcgttgcctatattcattcttttccgcgcttggccaagaccggtgaccatcggcggattttaacgttattacatgcactcggcaatccgcagcaacaagggcggtatattcacgtgactggtactaatggaaaaggctcagccgctaatgcgattgcacatgtccttgaggcaagcggtttgacagtcgggttatatacctcgccgtttatcatgcggtttaatgaacggatcatgattgaccatgaaccgattccggatgctgcgttagtcaaagcggttgcgtttgtcaggactgcactggaacggcttcagcagcaacaagctgattttaacgtgacggaatttgaattcattactgcgctggcgtattggtattttcgtcagcgtcaggttgatgttgcggtgattgaagtcggcattggcggctacacggattcgaccaatgtcatcacgccggttgtcagtgttttgaccgaggtggctttagatcaccagaagttgctggggcatacgattacggcaattgccacacataaggctggtattatcaaaccgggtattccggttgtaaccggtaacttggtgccggatgctgctgccgttgtcgcagccaaggttgcgacaacagggagtcaatggttgcgttttgaccgcgatttttcggttcctaaggctaagcttcacggttggggccaacggtttacttatgaagaccaagatggacgtattagcgatctggaggtgccgttggttggcgattaccagcaacgcaatatggcaattgcgattcaaacggcaaaagtgtatgccaagcagacaggatggcctttgacgccccagaatattcgccaagggcttgctgccagtcattggccagcccgactcgaaaagataagtgatacgcctttgatcgtcattgacggggcgcacaatccggatggcatcaatggtttggttacggcgctaaagcaacttttttcccaacccattactgttattgccggcatcttggcggataaagactatgcggcgatggcggataagctgaccgcggcattttccacggtttatctggttccggtgccagggacgccgcgcgccttgcctgaggctggttatgaggcgctgcacgaaggtcggttaaaggattcgtggcaggaagcattggcggcgagtcttaatgatgtgccggatcagccgattgtgatcaccggttcgctgtatttagcctcagctgttcgtcaaactttattagggggaaaatcatgaccgcaacagtcatctttgatcttgacgggacactggttaacactgaagcactttaccttaaaagtaatgttaaagccgcggcagtattgggactgcaccggacagaagcagattttcggccattagtcggatctgccggaccaagtgaagctaaaatcattgccgatttggttggggccgatcatgccgcatggttccagcaattttcaactcaggatgttttggaccagattcgcagcggtgccgattttgtcttacccggagttgacaaaacgttgcagatgcttgatcggatgggttatcgattagcgttggcaacaagtagtgccaaacattacgttgacgtggtgttggctgcaactggttgggtgaagcggtttgacccgattctgactggcagtgatgtgacggcacacaaacctgatccggaaatttatcacgtgatgaaaaccaagttgcctgagacaccagcgattgtcgttgaagatacgcatgtgggtgtggccgcagcagaaggggccgggctcccggtcgtcatgattccaggcatcggtcaagcgccggatcataaggcgaccgcgattttagctgcgatcacggatttgcctgactggctgcaaaatcatcctgcttttgcgtaatgtccataatgagtcttcagatgactcaaaatggcggccccatcagagaaggctgaagagcatgcagcgcctcactctgaaagcggcatgacggagggaaagacgatggcagatgcgactgaacaaccacgtgagcgtttattggcgcatggaccacaggcactgacggatgcggaattattgcaattgattgtgcgcgcaggcaaccagcactatccggtccaggaaattgtcagcgaggtgttgaccacttatccagcattacgaggcttagcagaaggtgatggtgattcactggaccatattcgcggactaggcgcggctaaacgggccagcattttggcgggtgtggagttaggacggcgggtcatgcgtcgtcaatcggttcgatatgggcagatcaaaaatagcgagcaactgggtaaaacgatggtgtcacgctttgccggagctaatcaggaatccatgttgattttatttttggatgtcaagaatcaaatcatcacagaacaaatcgtggcaattggaacggtggattcagccttagccgatccgcgggtggtgtttcgggaagcattaaaactaagcgccacgaatttgatcatggtgcacaatcatcccagcggtgatccttctccgagtcaggccgatcgtgatacaacaacgcgattccagctggcggcagcgttactcggcatgcacctgcttgaccacttgatcattgggcggcagtcgtattattcgtttgcgcgcgatgatccggaatttaattaatttgctaaaaagttgtaaggttttctgaaattggcgcaatgagggcaaaaacaggcggtttcacattttgtcacagaaaataatatgctataatgcatggagttaatacgaaatgagtcagcataaggagagaacgtcttgtttggatttggatcaaagaatatcgggatcgatcttggcaccgcaaataccttagtttacgtcgacggcaagggcattgtgttaaatgaaccctccgtggtcgcgaagaatacccagacggaagaagtcattgccgttggtgaagaagcccgcgacatgatcggtcgtaccccgaccaatatcgtggcgatccgaccaatgaaagatggggtcatcgctgactacgacacaactgcggccatgttaaaatacttcatgcaaaaagcattaggtaacggcagccacccgcaagtgatgatttgtgtgccaagcggcgtgacggaagttgaaaaacgggccgttattgacgctgcaaaagtcgcaggagcacgcgatgctttcgtcattgaagaaccttacgctgctgcaatcggtgccggtctgccggttatggacccgaccggtagtatggttgttgatattggcggcggcaccactgatgtcgcaacgatttcattaggcggtattgtttcgagtcgctcgattcgggtggctggtgacaagtttgatgaagccatcatcaatcatttacgccagaactttaatttgctcatcggcgaacgtacggctgaagccatgaagattcaaattggttcggcatcggttgaaaaggctgccgatatcgatgggatgaccgtgcgcggccgtgatttattgagcggcctgccaaagaccatcgatatttcggcaacggatattgcctcagctattcatgaaaacgtgcttgatatcatcacggcgattaaagaaacactagaggaaacctcaccagaaatcgctgccgatgtcattgatcatgggattgtgttgacaggcggcggtgcgcttttgaagcatttaccggatgtcatttccgatgagaccaaagtaccggtcttcattgcgcaggatccactagattgtgtggcaatcggcactggtgaatcgttgaagaatattgacgttttaaagaagcgttaacagcccataaatgaagatggtttgcgtgtggcaagaggctgggatgaaggatcctggcctcttttcgcgagtgtgacggaggaaccaatgcagaaattcttttccaacaaaaaattgatcgccctcatgatcgcattgctggtcagtcttggtctggtcgctggatcaatctatgcgagcaataatcgcaatacgccgccgtttattcagcggattgccaatgatgttgttggcatcggcgggcggttagtcgcgttgccgggagattttgcccgcaatggattagatgacatcaataatctcatggatacgtttcaggagaatcagcgcctcaagcaacagctggataatttagcgcagacaaaggtgcaggtacaaactttaaaacgcgaaaataagcagttgaagcaacagttgaaacttaacggtactttgacggattacgcgcagatcagtgctgctgtcattttacgaacaccaagtgactggcgcaacatggtcgttattaaccaaggaagtgccgccggggttaagaagggcatgccggttatggcaggttccgggttgattggccgtgtggttgaggtcaatcgaacgagttcaaaagttgagatgctatcaacagccaataaatccagtgaccggattgcggcggccgttgagactaaaggcgaaaaagaagttaacggcatcattaccggatatgacgaaaaaaccggtgatttgattctcggcgagctgaatacggataccgcgattaaaaaaggcgatgaggtggttaccagtggtttaggtggcatgacacctaaaggattactgattggcaaagtcgccagcgtcaagaaagatgactatgggctggccaacaccgtttatttggatcccgccgcaaatctaaacgatgtcaccgttgtaaccgtcatctcacgtacgatcaaaggtgactaacatgttaaacgaaaaacatttcacaggacattggtggatctttttactgctgcttttgttattattaattgatggcagcctagcatcagtgctggcacagtggatcatgcagccgaactttatggggacgccgcaattgaccttgttagggttagtcatggtgacgttgttggtgccgcaagaaaagtatataacctggattgcggcattgattgggttgttattcgacagtttctacacgggcattctagggattaatgcgttgctgtttgccttggtcatttatgtggttcgccagattcggccgtatatcccgcacacgccaatttttgttggtatggtttatattattgcgttgttgctctatggggttgccagttatgctgcgaatcattttattggctacggatccgccagtgttgttatgctgatagcgaatcatttagggccgggattaacggtcaatctcatcctttttgtgattgtctatggtccattacatcgattgttgatgaatttagcggaagaataatttggggtgataatgtggacagtgtggtcttaaaaggtcgaaatgatagtctggcgctgcaccttcaagatacagcggattttacgcagattatccagacactgaaaacattactaggcaaattgtacgaagaaacgccaaccggtgatgtcagctatcgtttggagacgggcaatcggcttttaacggaagagcagttggcgcaaattcaggctgtatttgaagattacccgcgcttttcaattaatggcatcacgagtgctgtggttgataaagcggtcgttgccgatatggtgacggctaaaatgacccatcgcatcggtggtgttgttcgatcagggcaaacaattgatgtcatgggcgatgtgctgtttttaggcgatttacatgccggtgcctcgctgtgtgcttctggcaatgtttttgtgatgggtaaggttagtggcgttatccaggcaggcagtcaaggagacacccgcgcagttgttgtgggtgacttgcaaggtgctagtcaagttcgaatcgccgatgtcatcgaaattgtcgctgaccattatgatccggttaaaccggttgcttatttgagcgaattacatacgatgacacataccaagttggctgaactagcaaatcttcggccgcgattatttaagcaaatggaggcaatgtagatggggacagcgttagtagtgacttccggtaaaggcggcgttggcaaaaccaccacttcggcaaatatcggcaccgcgttggctttacaaggcaagcgggtcgtcttgttggaccttgatattggactacgcaacttagacgttgtcatgggtttgtccaaccggattatttacgacattgtcgatgttgccactggccgcgcgaagctacaccaagcgttgatcaaggacaaacgatttgacgatttgctttatttactgccagcagcgcaaaatgcggaaaaagacgcgttagaacctgatcaggtcgttgagattgttgaacagttgcgaccggattttgattttattattttggactcgcctgctggaattgaacaagggtttcggaatgcgaccggggcggctgacggtgcgattgtggtcacgaccccggagatatcggcagtgagtgatgcggatcgggtcgtgggcttactggaacaacgtgatatgccgctcaaaccgcgactcattatcaaccgcattcgccaaaatatgttagctgatggccgctcgatggatattgacgagattaccagtcatctgggacttgatttactcggcatcattgttgacgatgatggggtgattgagagttcaaacaaaggtgaagcgattgtgatggatccggatgaccttgctagtaaaggctaccgtaatattgcccgccggttactaggtgatagcgtgccgttgatggacattcgtttgaaaaaacaaggcttttggtcaaaattgttccatcgccatcattagacggtttacggtgattttgtgccggctgttaaagattaattttctgaaacagttgactttcgttaaagttcggtgtaatttagtgacaattcattaaagcgttgagtggaatcgataagcggtcatggttcacagcgagttcgggttgatggaaaccgaatagccatccgtttatcacacatccatgagtggacgattgaacaacagtaggtcgtctcggttgggctcgttatcgccgtggttgaagcaactacatgaggttgattgtgtgagcaattgacaaatctgaggtggaaccgcggtttaagccgtcctcttacagcaaagtgctgtaagaggattttttaatggtcgcgatttttccgaaatcatgtgtggtgctgcaaccacatgaggccgagtgtgtgaacaatcggtaaactgaggtggtaccgcgcagaagcgtcctcttgcatcaagcaagagggcgcttttttcataccacgaacaagttgcccaaccgctcaactcatcgacagccacaaagcgcaattagaaaagaaacggatctgtgcgactcaaatataggcaggttcaaaggaggaagcaccatgacttatatttttcagattttaccggcattattatctggtgtgaaaatgacgttggggatttttgccatcactttagtcggagccattccactgggtctcattttatcagtcggcttaattcccaagcctaaatcgctacttggtaaggcaggaaaaagcttgctggaaggctatgtgtgggtatttcggggcacgccgctgttgttgcagctgatgtttatcttttacggcctgccgattatcggtatcgtgtttgaccgcttctcagctgctttagtcgcgtttattttgaattatgctgcttacttcgcagaaatcttccgtggtggctttggcgcaattgatgaaggtcagttcgaagcaagtacggtcctcaacatgacccgctggcaggcattgcggtttgtggtgattcctcaggttgtcaagattgtgctaccttccatcggtaatgaagtcatcaacttggttaaggattctagcctggtttacgtcattggcttaggcgatttgcttcgagcaggtaacattgccagtgcgcgggatgttaccttgctgccactggtattggtcggggtcatctacttactgctgacgctgattctgacgttcctacaaaaacggatcgaagcagcattttcatattatcgctaggagggttaaaaatgttagaactcaagaatatcagcaaagcgtttaacgggcggccagttctaaaggatgttaacgtcaagattgaagatggcaaaacgttagcaattgtgggtcccagtggcgccggtaaaaccaccttgttgcggatcatcagtggtttggaaagtgctgatggcggcaccatgatctggaacggtcagccgacgaccgcgcaggctttacgcaaacaaggtgtgatcggcgtggtgtttcagaactttgaattattcccgaatttgtcggttatgcgcaatattaccttggcgcctactttgcagggggttgatcaacaaaaagccgatgcgacagccaagaaacttctgaatcaacttgaactaagcgatcaggcgcaggcgtatccttattcactgtctggcggccaaaagcagcgggtggcaattgcacgggcattggcgctaaatccgcaaattctcttatacgatgagccgactagtgcgctggatccaatgttgcgcgataatgttgccgcaatggttaatcaatttaaagcatccggcatgactcaggtggttgtgacccatgacatggactttgcccaaagtgttgcagacacgacttatcacgttggcaaaggcggtgatggtcaatgaaacggcgaatgataatggccgtcatggtgtttttgaccatggccggtatcgtaatcagcggatgtgcgcgcgaaaccgtcgacaactcctggccgcgcattgaacggaccaaaaaagttgtgattgggttagatgatacctttgttcccatgggttttcgtcaaaaaaatgggcagttagccggctatgacattgatttagccaaagcggttttcaaacggtatggcattaaagcggatttccagaccatcgactggtcgatgaaggaaactgaattgaaaaatcagaccattgatttaatttggaatggttattccgtgaccccggagcggaaagcaaaggttgctttttcgaatgattatctgattaaccatcaaattgtggttaccaaaaccaaaagtcagattaacacgttgaaggatatgaaggggaaaaccttgggcgtgcaaaccggatcaagcggggcatttgatttagatgcccaacccaaattgttaaaaaatatgatcgccaacaaaacgccgatcctttacgataccttcaatgatgcatttattgacttggatgctgggcgaattcaaggcattttaatggatgaggtttacgcacgttactacattgcccacaagccggatcctgcaagttatcacattatcggcgactcattcccgccagagcagtttgcggttggtatgcgcaagtccgatcatgttttaagagagaaaattaacgcgggattgaaggcgttgaaggcagacggaacgattgctaaactgcagaagaaatggtttggcaaggtcgaacaatgagttgtatgttagcgctgataagggttcagagtttagatatcatggcaattttatgttgaagctggaatcattgtggttgtgtggatactgtctattgcgacaggtaactgcatgaaaactttgattccggcttttttgttggttgttcaacacgcctcccttaacgcgttcaccggcgcagggacctgcacatcaagaccttgggcgcaatgaccaaagtatggccatcacgcttgacgccgcttgggttctggtttatgtccataacgcgttcaccggcgcagggacctgcacatcaagaccttgggcgcaatgaccaaagtatggccatcacgcccaaggccacttatgttccggtttctaaccgggctggctcacgctcactggacttttccccctgactttctgtaaagtagagtatgataatcgcatgtagagactggacgaatggctgaggtgtgacattgtctggttagggaggcgaaatttatgtggcttgggctgattgttggcggtctttatatcattaatgcatttattgcgattgtgacggtgtttcggtcccatcgtgatatttctgctgtatgggcgtggctgcttgtgctgttgctgctgccgtttgttggtttcttaatttattttgtcttcgggcgtaaactgcgggcggatcgcatgcaggatttaatgacgcaacggctattgggcattaatgatttggtggttcagcaacaagaagcgcttgcggcagggcagccgttgattgggacgccaggtagcggtggggtttcggagctggtgcggacgttattgcgggcggacgatgcgttggtcacaactcacaatgaagttcaggtgctttctttgcgggaagccttttttaaacagttgtttgaagatattggcttggctaccgaacatattcatattgaagcctatacgattcagcctgatgcagtgggccggcaattgcgtgatttactgattgaaaaggcgcaagcagggatcaccgtgcgcgttttatacgatacgtttggttcgcacggtttaccgattagcttttggaaaggcttgacagcagctggtggtcaggtggagcgatttgtggcgaccaaactcggacggtggaatccgcgcatcaactttcgcaatcatcgcaaactgattgtgattgatgggcatttggcatacttgggcgggtttaatctgggcaaagaacatcgcggtttgccaacactgcgggatactcagctacgaattcaaggtaaggcggttgccgtgattcaagcgcgtttcctgatggattggaatggtactagcaagaagcaacaggtcaaagacgtcgatgtgctgtttcgtgaaccggttgtcaccggaaacacaaccatgcagattgtcgctggtggaccggggcagcaggttgaagcaattaaacttggctatttaggcttgattaatcaagccaagcgtagtatctggatcgagtcgccttattttgttcccgatgacagtttgttggacgcattgaccattgcggctaatgcgggagtcgatgttcgtattatggtgccgaagaaaacaaatcagagtctgatggccaaagcatcgcagttttacctcaatcaagtagttgccaatggtggtcaggcctttttatatgaagagggtttcttacacgctaaaacgattgtggttgacggcaagtatgtttcaaccggcaccgcaaatttcgacatccgttcatttaaattgaactttgaagttgctgcgtttctttatgatcatcatttaggcaaaacatttcaaaaactatttcttgcggatatggaacgtgccatgccgtatacgcaaaaggtcattaaggccaagaaacgaccagcacgcttggccgaagagttatcgcgattgctggcgccgattttgtgatgggctaaccattcactgattttttggtaattaaaaaagccgctgaaaaatcagcggctttgtggttatttggtgatcggattagatgatttgcaaacttgcgagcgcggtgagaacaacaccaagcacggtgataataatcatcacccaagcactaataatcgtcattttctggaatttgctctttttctttttctgcaccgaaaacaccacctttaaagttctgctgggtctcattgtactggtttttggaaaaaacggcaactaaaactgagcgcgagccggcgcggttagaaaccggagtgtaagcggcctcggacgtgatggcccgcttttggccattgcgttcgaggtccttacacgcaggtttctgggctggcgaacgcgttatgggcgtaaagggggactattggccttgggtgtgatgaccgggttttggtcatggcacccaatacaatgtccgtacacgcgaattcctacgctgaagagcgttaacttctgcttgacgcctttctttcctttgagtacggttaattgagaagtatcaacagacagcaccttacgtggttgctgccgctggagggaattgtcatggtgttgcttgcgttgggattaccaattttagtgtggctcttggttgttgccgctgtcgtctatttcgactttcatggtggttcgtggtttttcttactgacaatggtgaacctctgggccattttcgagttaacctttaccaaaagtccgaatttcatctgggtgattctgtttacggcgatggtgattgccttgattctggttgtttggcaggtaatccgcgaatatgacctgattattcaccgatattggcggatgttgacgcgcattctctccctggcaaccacttgttggtggcttagcggtatttttatttattttatgggctgagtcaccaccgacttaccacttgtgaaaaaatcccgtgatccttgtgatcgcgggattttttgtggcttaaatgttttttaaacaataaaataactaaattttgcttcagaagtggttagatgtggagaagagtggggcgttgtggtagactgaaaatcgtagggaggtgcaggccatgctcatgggtgaatttgaacgcagtatcgatgctaaagggcgtctgattattccagccaagtttcgtgagcaattgggtgcatcgtttgttttgacccggggcatggatggctgcctttttggttatccaatcgcggaatgggacaaactgcaggcgaaattggccacattacccttagcaaaaaaagatgcccgcaccttcacgcgttttcttttttcggccgcgaccgaatgtgaaattgacaagcagggacggatcaatattcccaagccactgttcaaacatgcggcgttgaaaaaggattgcgtccttgtaggggtcaatacccgcattgaagtctgggatgccgagcgctggcagcaatttgccgacaccgctgaagaagactttgatgacatttcagaaaacttaacggactttgggttatagccatgacagaatttaaacacgagacagttcttttaaaagaagcaacagcggctttggccgtgaagtcggatggtacatatgtggatgccactttgggacgcggaggccatacccgccagattataaatcagcttacgaatgggcgtctgattgcctttgatcaagacgaagcagccatcgccgcggtcaagcgtcagtttgggacgttaccgccgcagctaacgctggttcaccgaaactttcgggatttaagcgcagccttggctgatttggacattaggcaggttgatggggttttgtacgatcttggcgtatcttcgccgcaatttgacgattcaaagcgtggtttttcttatcgtttcgatgcaccgcttgatatgcggatggatcagcggcaaacgcttgatgccaaaacgattgtcaatgaatggccgtatgctgaattggttcggatcttttcgcgctatggtgaggagcatttttctaagcagattgcgcgtcgaattgagcaagctcgtgcccaagcgccgattacaaccactttccagcttgttgagttgatcaaggcaggaattccggctaaagcaaggcgaacaggtggccatccggctaaaaaagtctttcaggctatccgaatcgcggttaatgatgaattatccgcgctagaagcttctttggaacaggcactcaagctgattaacgttgggggacgcatcagtgtcattaccttccagtcattagaagaccggctggtgaaaaccatgtttaaagaagtgtcaaccgtccaagatgttccgcgcgggttgccggtggtgccggaagctgctcaaccacattaccagttagtcaatcgtaaaccgattttaccgagtgcggccgagctggctgaaaaccatcgtgcccacagcgccaaactcagggtgatcgaaaaaattcgcaattaggggggttccatatatgcttgagagtacagcaaggcctttagtgcaacaaccggcaccgaaaccggtacataaatcagctcctgcacccgcaccgcacacacatattgcttttagcgggttcgagaaaacgatgatgtttgcctgtggcgttttagcaacagttgtttgtgtcgtttgtttgttcatgcaaaatcgcttgagcaacacgcaacgccagtatgaagatttacaggcgcaaattatgaagcaatcgcaagccacggcgaatctcaagcaagaaattggcgaactctccaactccgaacgacttgatgcctttgctaaggcccatggatttaaagtcattaacggcaatataaggcgtgttgataatcaatgaaaattttcaaatcgaaacgatcaacgaatgcacatccagcccgcaaccgtaaatttttcggtattgggctgatcgggtttacgcttctggtactcggtgggttcgttcttcgtttttcttttgttgcgaccattggcgaagtggattcaaataatctggcgaagcagcggcaaaagcagtatcagaccgacaccgttttgcaagcgcagcggggtgctattttggatcgtagtggtaatgtgatcgccgaagattcaaatacgtataccatttatgccatcctcgataagcaaaacaaaaatggcgataagcctgattatgtcaccaacaaagctaaaacggccaaaatactgagtcgttatttggcgattggtgaagataaagttttagcacgtttaaatccaagtaagaatcttttccaagtcgagtttggtcggccagggacgaaattaagtttggcgatcaaaaaacaaatcgaagctgagaaattgccggggattcattttcgcgaaaccccatcgcggctttatcctaatggtgtgtttgccagtcatgtgattgggttggcacaagcgcaggataatggcggcggtttgaccggggtgatggggttagagaaacaatttaataccgttttaaccggcaccaatggctatcggcgaagtgaaacagatgcatatggatataaactgcctaatgccaagaccaaagccaaggccccagtgaatggcggcagtgtctatacaacgcttgatagtggccttcaagcttatttggaaactcttatgacagacgttcaaaccaaatatgaacctaaaggcatgacggcggttttgatgaatgccaagaccggacgtattttagctgccacacagcgtccaacgtttgatgcttcgactggcgaaggattaggcgatatgtggcgggattctttggttgaggataattatgagccgggatcggtaatgaagatcatgaccttggctgctgctattcaaagcggtaagtatcaccccaatgaatatttccagtccggatcggttaagcttgatggcggcacggttaacgattggcggacaggcggctggggatccattccgctgagcaaagcgtttccgttatcgagtaatgtcggcatggttaagatcgaacaggaaatgggtgccggcatttggaagagttatttggataaatttaaatttggccaaaaaaccggcattacgttaccgggagaaacaagtggccggattagttttcaacgtccattggatcaggctatcaccgcctttggtcaaggcattgaagtcaatgtgatgcaaatgatgcaggcaatcagtgcggtggcaaatgatggcaagatgcttaagccgcagattgtatccaaggtggttaacaagaacggtaaagccactgtttataagccggaagtggtgggtcagccgatctcaaaggaaacggcagctcaggttattgatgccatgcgtcacgtggttaatgacgaagacggaaccggggtggcttataaaatgccgggtgttgacttagccgttaaaaccgggaccggtcagattgctagtgctcaaggcggctatttaaccggggattccaattacacgtttagcgttgccggaattgcgccggcctccaattcaaagtatgtcttatacgttgcgatgaaacagccacagaagatgacggaaccagcagaatcaatcttggcaagcatcttcaagccgatgatgcaacgggctttggacacgacagcgaatagcacggtgtcaggtgaaaccaacactgctgaagtgcctgctgtcaccaatgcggcattggcgagtgcacaggataccgttaaaaaggccggatttgacgtagcaacgatcggaaccgggaataaaatcgtccaacagttgccagcaagcggaaccaaagcattgcgggattcacgggtgttacttttgacgaatggtgccatgacgatgcctgatctcactggttggtcgaaatccgatgtgttaaaatttgtacaattgaccggcaagaaatttaagcttgtcggtgatggcttcgttgttcggcaaagtattgctaaaggcaccttattaggtaatgccagcgggacaatcgagtttaaacaacaatagaattggggatagtcatgcaacttgctcaaatgctcattccaatggtttcggcatttgccattaccattatgtttatgccgctttttatcggttacatgcggtataagaaagaaggccaggtgattcgtgaagaaggaccaagctggcacgaaaagaaatcaggcaccccaacgatgggcggcttgatattcattgctgcgatcatcatctcggctatttgggtcagcatttggcagcaccaactaacgctgagtgtctggatttccttatttattttggttctttatggcttgttaggattttatgatgatttccagaaattggtgcaccatcgtaatgaaggcttgaaggcgtggcaaaaattagccggtcagatttttggcgctgtcatttttctgatcgcttattttcacgaaggctttgatcatacgttatgggttccggttttaggtaatgtcaatgccacgtggttttatgtgatattcgttgttttttggctcgttggttttagtaatgcggttaatctgacagatggtttggatggcttggttgccggacagacgaccatttcgtttgcaacgtatgcagtgattgcggttcgtgaaggccgcgttgacgtgttgattatttgtctggtgactgtcggcgcgatgcttggatttttgatgttcaatcataaaccggcccagattttcatgggcgacctgggatccttagcattaggcgggatgctggcagttgttgccattttgcttcatcgagaatggtcgttattattgatcgggatcatctatgtgattgaaacagccagtgtgatcttgcaggttgcttcattcaaattaaccggcaagcgaatcttcctcatgtcgcctattcatcatcattttgaaatgaaaggctggtccgagtggcagattgacttgaccttctggctggttggactgatcgcaagctgtgtttatctggtatttttcctataaaatcaagctataaaaagaaggaacgattgtgaaaaacatttcggattatcgtaataaaaaggtgcttgtattgggactggcaaaaagcggcgtcaatgcagcgcgcttactacataaattaggggctttggtaaccgtcaacgataagaagcagttcgatgacaacaaagaggctcaggagttgttggcagacgggatgcgcgtgattaccggacgccatccagttgaattgttagatgagcattttgagttgatggtcaaaaacccgggtattccatacagcaatccgatggttcagcgcgcgcaagaattgggcctgccgattattactgagccggagctagcttttcaggtatccgaagcagagtggatcggcattaccgggacgaatggcaagacaacgacgaccacgctgatcgggttaatgttaaaccaacagtggcctcaccatgcgtttgatgctgggaacatcggcattccggtcagtcaggtggcacaaaaagcaggtaaagaagacactattgttgctgagctatctagttttcaactctgcggcattaagaccttgcatccccatatcgcagtgttaacgaatatctatgaggctcatttggactggcatggcaaccgcgctaattacgttgcggcgaaaatgcgcattacgatgaatcaaacgccggatgattactttatcatgaactgggatcttcccgaaatgcaccagttagcaaagcaaagtcaagcccagattgtcccgttttcgcgcaaacaggccgctggtgcacgggcttcgttaattgatggctggttgacgttcgatggtgacaagattatgcctgccagtgacctgcagattccggggttgcacaatatcgaaaacgccttggctgccattgccgcggccaaactgaaaggtgtgagtgatgacgcaattcgtgaggtactgcggactttttctggcgttaaacaccgaattcaatatttggaaacgatcaatgggcgtcgggtatacaatgactccaaggcaaccaatgtcgaggcggcaaccgtagccttgaatgcattccagcaaccaattgtttggttggcaggcgggcttgatcgtggtttgccgatggatgctttaaccccgctcgttaagaagcacgtcaaaagcatggtcgtattcggtcaaaccgcatcattaatggcaaaaattgctaaagatgccggtgtcccggttcaaaaaaccgagaatgtcatgacggcggttccattggcctatgaagccagccgccccggcgatgtgattttgctttcgccagcagcagcaagttgggatcagtatcctaactttgaagtgcgcggcgatgatttcatcaaggcggttcatagcctacagcaaaatcttgaaagcgagggtcattaaatgcggctggttatttctggtggcggtaccggcggccacatttatccggctttagctttgattgaagccctaaaagcagaaggcaaacttgatgatgttttgtacgtgggcacgcaaagaggcttggaaagtcggatcgtaccggcaaccggcttgaagtttgcaaccctggacttgcaaggctttaagcgcagcctttcgttaagcaatgtgacaacggtcaaaaagtttatcggcagtctcggtcaagccaaaaagttattgcgagattttaagcctgatattgtcgtggggactggcggttatgtttcaggggccattttatatgctgcggcacggttgcatattcccacggtgatccatgagtccaattcggttgctggggtgacgaataagtttttaagccattttgtcgatcgagtggcgattgtctttccggaagttgcatcctcatttccggctaagaaagtcgttgtcaccggtaatccgcgggcacaacaggttgccggcttaaagcccaatgaccggcttaaagattttggactggatccgcataaacgaacacttttgatctttggcggttcgcgcggtgcccctaaaattaatgcggcagctgttgcggcgttgcctgtttgggctaaggcagactttcaagtgttatttgcaactgggcgcagtcactatgacgccattaatgcgggcttgccagcgttaccggcatctattaaggtcgttccgtacattgatgacatgccatcgattttaccggacatcggtttgttgattagtcgcgccggtgcaaccacacttgctgaaattacagcactggggatcccggcaattctcattcccagcccgaatgtgacccaccaccatcagtacctgaatgcacaaagcctaaccaaaaaaggtgcggcattaaccattaccgaaccagaattgaatcagaattttccccagcgcgttgtgactttgatggaagatgatgcaaaacgcgctgcaatggcacaggcatccaaaagactgggcgtgcctgatgcaagtgatcaattgattgcggtgatgacaacactacttacgaaacgtgggtgatgactttggcttggctccgaaaaaaagaacagcaatctgatccgctgacgccgtggcaacaataccaggcacgccagcagcagacgccgcgtcatgatcggcgccaaaaaccgaagttggatgttaatctcccgaagatccagacgttgcggcgccgtaaactcgtgaagaaccttgttttgattctgctccccctgctgctattgctgggggtttttggctattttgccagcccgctatccaaagtcggacttgtgagtgttcaaggcgtgacaacggttccggatcagcaggtcatcaacgcgactaaattatcagacgatgacttgatgttgagtgtggcatttcataaaaatgccattgcgcagcgggtgcagaaatctttaccagaaattaaaacagccagcctgacgatcaagggattcaatcgtattattattaaaaccagcgaatatcagacggtcgggtatgtttatcaaaaacacgcgtaccacaagattctggttacgggggaagtgttagccgccggaacccaaacgccagtcacgacttatccggttttttccgggtttacagccaaagagttaccacaaatgattacgttacttaaacagttccctgctgccattcggcgtgatatctcggaaattgacgccagtcgcggggatgccaatcctaaccagattgcgctcaacatgaatgacggttatcgcatcattgccgatacgcgcaccattgccaagaaaatcaagtattatccggcgattgtttcacaggttaagcaaaaaggcgtggttgatttggaagtgggagcattttggcgaccgtattctagtagcgaaaagtcgtcaaatgactgattttgtaaggatcgttttctcatcagaaaatgagtgtgttacactgatgatggcaccgttttaatatgaaaattgagttaattaaaaagttacacaaggaggttcccgatacatggataatcaaggtatttacgttggacttgatatcggaaccacctcaataaaagtcattgttgccgaagcagtacagggacaaatgaatgttattggtgtgggaagtcagcggtctgaaggcgtgagtcgtggggtgatcgttgatatcgataaggcagtcgcagtggttcaagcggccgttgcccaagctgaagacaaggcaaatatcaagatcgatcgggttgtagctggcatccctgctaatatgctgcagattgaacaggtttcggggatgattgcggtcggcgaggaaaacaaagaaatttccgataaagacgtgcgcagtgttgctgcggcagcattagtgcgtaatctaccgcctgagcgtgaaacattatcgctggttccaaccgaatttatcgttgatggctttgatgacattaaagatccacgtgggatgttgggtgttcggctggagatgcgcggtattatgctgacagttcctaaaactgtgattcataataccaaaaaggccatcgaaaaagccggcttgcgagttggcggcttggttatttcaccactggctattggccggcttgcgttaacggatggcgagcaggactttggcaccgtcttgattgatatgggtggcggtcaaagcacggcagcagtgattcatgaccgtaagctcaagttcacttcggtggatcaagaaggcggggaatacatcaccaaagacatttccgtggtgttgaataccagttttaccgatgccgagaaattgaagcgcgagtatggaaatgcggattctctggctaccagtgaagatgagacttttccggttacggttgtcggcaagcatgatccggccatgatttcggaaaaatatctgtctgaaattatcgaagcgcgggttgctcagatattcaagcgactcaagaaggcactggatgcggttaatgcgcttgagttgccgggtgggattgtcattaccggcggcaccaccgcactgccgggtgtcaccgagttagcccaggacattttagagcgaccggttaaacggtttattccggaagatatgggcctgcgccatccgtcatttactgaagggttagcgctcatcaagtacgccgctgaaatgacggatattgaaatgcttgtttcaagcgttttgccaacaccgtttatggttgatggggcgcaaatgccaacgcaaccggcacggccgcaacaagaaaccccggcggcaccggagaatcaacgttctgccaagcgcaaacctgataaacaacccgaaaaagcaaaatctaaggaaccatctcctttacgccggttctttggtaatttctttgaataaatctcgatcctaggaggaacacgaatggattttcaaatggacgcacaaagtgaaaaaggtgccaacatcaaagtaatcggtgtcggcggtgcaggcggtaatgccattaatcgcatgattgcagaagatgtcaaaggcgttgaatttatcgctgccaataccgatttgcaagcattgaatgccagcaacgcagaaaccaagatccagctcggaccgaaattgacgcgcggcttgggcgctggttccaacccggagattgggcaaaaggcggctgaagaaagtgaagaggcgattggggcagcattgcaaggtgccgacatgatttttgtgactgccgggatgggcggcggctccggaaccggggcagcgccaattgtggccaaaattgccaaagatcaaggtgcgctgaccgttggggttgttacccgcccatttacgtttgaaggccctaagcgtgctaaaaacgccactgaggggattgctcagttaaaagagcatgtggataccttggtgattattgccaacaatcgtttattagaaattgtcgacaaaaaaacgccgatgctggaagccttccatgctgcggataatgttttacggcaaggggttcaaggtatctcggatctgattacaagtccaggctacgttaaccttgattttgccgatgtaaaaacggttatggctaatcaaggatcggcgctgatggggatcggcagtgcaactggtgaaaatcgcaccgttgaagcgactaaaaaagcgatttccagcccacttctggaagttaatatcagtggggctaagcaggtgctgcttaacattaccggcggcccggatctcagcttgtttgaggcgcaggatgcttcacaaatcgttgcggatgcagctaaagatgatgtcaatattatctttgggacttccatcaatgaagagctcggagatgaagtggtggtaaccgtgatcgccactggtatcgaagaagaagaccagcgccgcgaaacaacgcgccggccagccgctgccaatcgtaacactgatcagacccagtcaaacgggtcgtatcggccaacattcggcgggcatgaacagtctgccgatcaagcccctaaaaatgatgatccgtttggtaattgggatttgcggcgggaaccaagcaagcgccagaccccgagtgcagatgatatgaacaacgttaagaagaaagattttgatattttcgagaatcaaaccaatgcagacgatgcaggaagcgatgatcagccgccattctttaaacaacggcggcgtcagtagtcaggaggtcatgaaacatggcgtttggaaagttaggggaaaaattcaacaatttctttgccatggatgacgaagatgaatatcaggaccaagaagacgaacaaacgcaggctgcacctaaggaaccttcaaatcatggccagtatcgtagcaacaaagtcgtatcaatgaatagtccggttggtaaaactgccaaaatcgttgtgtatgaaccgcggatttattcagatgccaaagagattggttcgcatttactgaacaatcgcgcggtcgtcattaactttgatcgaattgaggccgatgatgcacggcggattgttgatttcttaactgggactgtttttgcgattaatggtgagattaagcggattggtgagtcgattttcttagtcacgccagccaattttgaaattgatggttcattggctagtaccattgattccgatggtttgaatctctcatcgcaaccataaacgaggtgtcaagtgtttaattttctttatgcattatttcgagtcggcgattgggcgatttatttatacatgatcatggtatttatttatatcctgatttcatggtttccaaacgctcaaggaaccgccattgaccgtttgttaggccggtgggttgatccgtttctgagtatctttcgccgtatcattcctgctattggtggacttgatctttcgccaatcctggcgttcttcgtgctttcgctgattaagtttggatggtcgcggttgtttctgatacttgttcaaataattgggtgacaagcatggatgccatctatcaacattttcgcaaagatgaagcagcattgattgatcattttgcagaattaatcgaaactgcgcggactgagtatcgggcagtattaaccgattttaccgatcctaggcagcggttgattgctgcgagcctgatcaatgcacatgatgatatgaagttggtacatttcggcgggtatccgcatgctgaacggcaacggctgatttttgcaccggactactttgccgctcagccagctgattttgatattcggcttttacaagtggtgtatcccgaaaagtttgccgaaatgcatcacagtacgattcaaggaacattgttaaatgccgggcttgatcgggatgttttcggcgatattgtgacggatgggcgtacctggcagttttttgttgccgcgcatatggaagattgggtgatgagtaatatcaccaagatcgggcgtgtcggggttcattttacggactatccgttagccgctgccgttacgcctgaaaatgactgggaatccatcagcttttcagttagtgcactgaggttggatgccatcgtggcccacggtttcaatatgtcacggcagcgggccaagatgctaattcaggcgggaaaagtccggctgaactttggcgaaaacgatgcacctgacgctgaggtcgccacttctgatattatttcagtacgtggatttggacgattgcgactagatgcgatacttggtgaaagcaaaaaaggtaaattgcgtgtctctgctgccgtgattcataagtaaaccgtatcgtaggcggttcaatgcgcttggtttatcgatagcggcaactttttaacaggttgcagcaatcagcgcctgatgagggacgtatcaataagctaaagtacgttcatgatcacgcgtatgccggcctgacaagcggttggcgcacgttcactagaggaggaggactatttatggctttaagtccactggacattcacaataaagaatttagcagcaagatgcgaggttatgacaaggatgaggtcaatgattttcttgcgcagatcgttaaggattatagtagcctgatcaaggataatgaggggcttaagaaggaattagcggatgcaaaagaaaaggtccgttacttcaccgatatgaaagaagccttgaatcagtcaatcattgtggctcaagaaagcgctgaaaaggtgaagaacagtgcgcatcaagaagccgatttgatcaagcagcaggcgcaacaagatgctcaggggatcctcaaccgtgctaaggctgatgctgatcagaaagtccaccaagcccaggcgcaaaccgagcagacgttgcatgatgccgaacttaagcgtcagaacatttctgttcaaacagaggatttgaaacgccagagccgggttttccgtcagcggttacaggttatgctggaatcgcagttggaagttgtgaaaagtccggaatggaaagaattactgtccagttctcctgaagctgcagataccacggatccaagtcaagaagcacttgacaattcgcaggctggtttcgtaaactctagtggagcagtttccggtgctgatgcgtatacggagattattttcccagatgaccaaagtgcaacatccgagtcggcaactgcaacgccggcaccggcggattcggagcgttccgaatcagaagcgtcaacaagcgcaaccacaagtgccgataccgatgttacaactgatcaaaatgcacaataacgtatgaacacgcgtcatttgccggtcccctttgcagcgagtcaggaataggtgtgagcctgataagtaccgctgaatgatatcagttcgcagttgtctcgccgaataactaagcgagaccggttgatcaccgttaagcaatcactgagggggacttgttccctgaagttaggtggtaccacgtttgctcgtcctaatatagggcgggcttttttcattcaattaacaaaggagcgggacacgtgaaaattaaagatacgttgaacatgggcaagacgacttttccaatgcgagcaggcttgcctaaaaatgaaccgatttggcaaaaaaagtgggatgaagaccacgtttacgagcaacggcagaaattaaatgaaggcaagccgacgtttatgctgcatgatggcccaccgtttgccaacggaaatattcatatggggcatgcgcttaataaaatcagtaaggatattatcgttcggtataagtcgatgaatggcttccgggcaccttatgttcctggctgggatacgcacggtttgccaattgaacaacagttggccaaacaaggcgttaaacgcaaggaaatgtcaatgaccgactatcgcgagttatgccggcagtttgcgatgaaggaaattgataagcaacggactgatttcaagcggcttggcgtcatgggtgactgggaacatccgtatattacgttacaacatgcttatgaagccagtgaaattcgggtctttggtgccatggcgaagaaaggttacatctatcatggcttaaagccggtttattggtcatggtcatccgaatcgacgctagccgaagctgagattgagtatcatgatgacaaatcaccttcgatttatgttgcctttccggtggttgatggcaaaggaatcctggatcaagatacgtcacttgttatttggacaacaacgccttggaccattcctgccaactacggcattgcagtcaatccgcgcttcgattacgtccaggtgcaagttggcgagcataagtatgtcgttgctgccgagttgcttgatcgggtagctgaagaagtcggctgggaacaacctaagattttaaagacttttaaaggcactgaaatggataagatgacagccaagcatccgttgtatgatcggacaagtctagtgatgaatgcggatcatgttacgcttgatgccgggactggcttggttcatactgcccctggtcatggggaagacgactataaggtcggaatgaaatatggcttgccggttatttcagtggttgatgccaaagggtacctgaatgaaaatgcccctggttttgaaggcgtcttctatgatgatgccaacaaactcgtcacgaaagctttggacgaaaaaggcgccttgctgaagttggacttcttcacccatagttatccgcatgattggcgcaccaaaaagccggttattttccgcgccactacccaatggtttgcatcaattgaggcctttcgtgatcagattttgaaggccattgatactgttgactttaaaccgagttggggcaaaacgcggctgtacaatatgattcgtgatcgcggcgattgggtcatttcccgccagcgcgcatggggcgtcccattaccgattttctatgcagaagacggtgagccgattattgaagaagcaacgatcaatcatgtagcggatttgtttggtaaatatggttccaatgtctggtttgaacgcgaggccaaggatcttttacctgatgggtacaccaatccgcacagcccaaatggcaagttcactaaagaaaaagatattatggatgtttggtttgactcaggttcatcgcatcaagctgttttggcacaacgtcctgaattgagcttcccggctgacttatatctggaaggttccgatcaataccgcggctggtttaactccagcttgattaccagtgttgctgcaaccggaatcgcgccgtatcgcgggattttgtcacaaggcttcacgcttgatggcaaaggccggaagatgagcaagagcttgggcaatacgattgtgccgtcaaccattgaaaagcagtttggcgctgagatcattcggctctgggttgcaactgttgattcatcatctgatgttcgggtctcagtcgataatttcgctcagacgtcagaagcctatcgtaaaatccgcaacacgctccggttcatggttgccaataccggcgatttcgatccggaaaaagacgtggttgcctatgatcagctaggttcagtggatcgttatttgttggttcggcttaatcaggtcatcgccaaagtcaaagaagcgtatgatgcctacgactttgctacggtagagaaaaccatcagcagtttcctggtcaacgatttaagtgccttttatctcgatgttgccaaggatgtggtatacattgaagctgcaaacgatcctaaacgtcgcagcatgcaaacggttatgtacaccgcattgctggacttgaccaagttgttgacgccgatcctgccgcatactgccgaagaagtttggccgtatcttaagcagaaacaagcatacgcagcgttatccgacatgccagatgtgacccactttgctgatgaggatcagctcttagatatctgggcagcgtttatggattttcgttccgaagttcaaaaagccttggaagttgcccgtgacaacaaggtaattggtaagtccatggaggcagcggtaacagtttacccaacggagccggtacgcgacatgctcgatgatgttgaagccaatgtgatgcaattgctgattaccagtcactttgaagtagcgccacttgaggcgaaggcgccggaaaatgccgaacattttgaggatatggctgttgtcgttgaacatgccaaaggaacggtttgcccacgttgccggatggtacgaaccgatatcggcacagatcccaaattgccggaattatgcagtcggtgtgccgcgattgttgaagctaattatcctgaagcggcagcaaacggatttgataagtaagcggaggctatgatgcaaggacgggtcaaaaatttcaacgtcgataaaggctatgggtttattgaagctgaagggcagcctgacatttttgtccacttttcggcgatcaatgagtctggatttaaaagtctgacgcccggtgaacaagtcgattttgtcattgtcgaaggtccgcggggtccgcaagcagcaaatgtcacgatccatcacgaacccgacactgaggatcatgcataaattctcgttcaatcgtgtgacgtgattcattaaaagcaatccgaacagtctgtctttgggtgacaagctagtaatgcttcctagcaagtacgtctgtggctgtcaggattgctttttaatgttgacgactcaagtttataggacaataagaaaaccgcgatcagtgcgttgatcgcggtttttgtatacatgctgctttttatttggtgatgctgggtaggttacttgttaacttcttcaatcttaccgtcataagtccgagcaacggtcatcttggtgattggaatatagcctaactttggaaccagggtcttttgaacgttcttggactggatatagttgataaatgcggcagtcgatgcattcggcttgcctttggtgtacatgtgttcgtaagcccaaatcttccaggtgtttgttgtaacgttcttatcagttggttgtactttatccagtgccagcttttggacgccatctttaattgccgagaaggctagatagctaatagcaccgggagttgaggagaccatctgataaacggtaccgctagaatcctgttcctgactggtcttgactttatcggtcttgatcccgaactgttcgaaggttgcccgggtacctgaaccttgcgcacgattgatcagaacaatttgctgatctttgccgccgacgtctttccagttcgtaatcttgccttggaagatatcgatcaattgctgggttgagatgttcttaacccctgcatctttgttgaccaccggcgcaatggcaacgaccgctacctggtgatccaccagatcatcggccttcaagtctttcttttcttgagcgaaaatatccgagttaccgatcgtgaccgatccggctgccacttggcttaagccggcaccggaaccaccgccttggacagtgatctccgcctttggattatctgtctgatattgtttcgcggcctgttccaccagcggttgtaaggcagtggatccgaccgctagaattttgctttgttttgccggtgctgaactggatgaacttgaactgctggcggattttgacccgcaacccgttaataccaaagtggcagttaaggccacggtcaaaccgactaacaatttcgaatgcttcattacttttccctccaatacttgaataactttaggatacgatttgtgtgtaaagacttgaccactttgatgtaaataatgcgttttgcttttgtaaatatgttcaacagtcctttgaaaaagtaaccaaagtcggcgtataatgactcagttaggcgttattaaaggagcggaaaatgtgaaaaattacattgaggatcaaaaagttcagaaaaaccggtggtggatcatcacggcaattgggatgtttaccattatgtcgacattggatggttcaattgtcaatattgcgctgccggtcatgagtcgcgatttaaacattccaatgaatcaagcggaatgggttgtttccatttatttgatgatgatctgcggcttgttgctgttctttggcaaacttggcgattcgatcggtaaaatcaaagtatttcgaattggcatggttttgtttttaatcggctcgctttttgctggtttcaataatagtttggcgttattactggcggcgcgaattgtgcaggcgaccggtgcttctatgaccatggccaataataacggcatcgtgacggaaattttcccgatgaatgaacgtggcaaggcgctgggattgattggttcatttgtttcgatcggcgccattgccggacccggaatcggcggcctgattcttggtcaactgccatggggttatattttctggattaatattccaattgggattgttgcacttattctgggaacagtcgtcttgccaaaagatttgccaagtaagcgggtgccaatcgattggtcaggatttattagttttctggcgttcattctcacgctttttatggggatctttttgggtcaggaacgcggatttactgacccgctgattcttgggttatttgtaatcgccgtgattgcgttggctgcatttgtacaaattgaacgacacaaaaatgatcctttggttagttttaaattattcagtaacagcgcgtttacactgagcttgttgtcggcattcttcattttcgtaaccaacttcttttttaacgtgatttcgccgttttatttgcaaaatgcgcgtgggttatcaccggaaaaagccgggtacttgttgatgatttttccgattgtgcaggttattgtggcacctgtagccggttcaattgcggatcggatcggaccttatcgaattaccatggtcggcttgttgtttattgttggcagtcagatcggctatgcattgtttaatttacaaacgtcttttgtttttgtcgcgttgatgatcggcttggttggttttggtaatgggttgtttcaagcgccaaataatacagtcgtgatgtcgagtgtggcgccgcgagatcttggaattgctggcgggatgaatgccttggcacgtaatttgggcatggttgtcggcatttcgagtgcgaccacggtgctattttcctcaatgagtcatactgccggacgcaaggtgacgacttatctgacgggtcagccgaatgtgttcatcgccggtatgcatgtgtcattttgggttgcaactgccttatgctgcctagctctggccttgacgggttatcggatgtggcagatgcgcacacaaacgcaggcatgaattcggtgatgagaactgataattgctgaatcgtacaactatacgcaaaaagcccgtgatcatcgtatgatcacaggcttttttcaaagtattgacgcaattatcaatggcgactgagtagatttaacttagtgtggcgtcacgtctttgggattttgttcgttcatactgccgtgcgtgtagtttaataattgttgctttaattcgccttccatttgtactaactgcttttcggcattttggcgttttagacggccgtcttgttggatctgcaaggtttgtttcaaggtatcgataagatcgttttgggtttgggtcaatgtttcgatatcgacaacgccgcgttcattttctttggcagtttcaattgagctgattttcaacatttcgctgtttttcttgagcagatcattcgttgtttccgaaacctgacgttgggcggttaccgcatttttttgccgtaaaagcgtcagggcgatggccacctgattcttccatagcggaattgctgtgttgacgctggcctgaattttttctgccagtgcttgattggtgttctgaataaggcgaatctgcggtgcttgctgaattgtaatttggcgcgccaactgtaagtcatacgcacgtttttccaaccggctggcaaattgcttgagatcattgacttgttggatcgccatttgatcattagcggcttctgcggctttggctgcttcgggaatcgttttttcatttaactccgcgattttgagattggccgcttcgatgtaaatattcagggcatcaaaataggctttattttggtcataaagttcgtccaaaagtttattgtcatttaacagaccttgttgtgaagtctcaaggcgattggcaatggtgtcgatttgcgcgccaatcttttgatacttagccgtaatttcgtagatcgagcgcttgacacggccaaagattttgcggaaaatattattattttctgcttttagctcatcggggttggcctcatttaaacgtgtcatcaagctggttaaggcatcaccgactgcaccggtatcctgactttggacttttgtcagcatattttgggaaaagacgccaagctgcttttgagcatcggcaccgtaattaagcacggtttcaccttttgtgacatcaattttactggctaaatcccgtgctttggcttcctgttccggattcaacttaggtttagctgtcgtcgcttctgggatgtttggctcggcagtggcgtctgttgctgtgctgaacggatcagctaataaatcatccgtcaaattggtttgtttatcatcgctcacgttggtcactccgtttcatgagttttttcgggttcaaggtgttttttagctaagcgcacatcgctatcgagatcatctaagtcgtctttaatgaaggcttggtaatcagtgcgaatcttgccagccatattcgtcatggtttcaaaggctttatcaagcgtttcataagtgtccgcggttttaacctcatgatgggtaatttgagcatacttttgcatgagatccaacagatttggcacttgttgatagacgaaggtacccgcatcggtcaagcgttgcggtgcctgaactagggcctcaaaataagcgtggagtaaatcgactaaatcagtgtttaaggttaatgcccgtaatttggggacttgttgggttaaggcttcaatcgtgcgaatttgctcggcaagatcggccatcgtctttctgaaaagtttgatttcttcttcacttaatccagatgccgcatagtgttccgccattttgggatctaaacttggcagactggcagattttggcttgggccgactcaattcaccgataaagcgggcaaatgcgaaaacggcaccgacaaaaatggcaatgagccatcgtccggacaaagcacctaatactgcacccatggcggcccagagtatgattcgccaagtgcgaatacgtttgcttgtggccacgagatcacttcctctttcgtttgagtttagtttagcacacccttgtaccttgcctatcagccgtaagttggatattcgcaaattttttgttaagaacaagcaccaaattgtctgctggtgtaagctgatgacatggctaaaaaaactgatcgtcaatcggacttaagagcattgacgaataacgacactattttaacaggaggcgatcatggtggaagaaaaaccaattgcccagcaacgcttgtttaccggtcacttagttgcggttgatgaactgacggttaaattggataaccagcagacggctaaacgtgagattgtccgggcgcacccagcggccggcgtgttggcgctcaaagatcagcgcgccttattcgtgagtcaatttcggtcaacagtcgggcagctgacgttggagattcccgctggcaagattgcgccaggcgagatgccattagcagctgcccagcgcgaattaaatgaagaaaccgggatgcaggcgcgcgactggcaaccgttggcaagttattttcagtcactcggtttttccgatgcaaccatggcactttttttagcgcgtcacgtcacaaccgctgagcatcatttggatcaggatgcagatgaatttgtccaacatcgctggttaacgctaagtgaagcgcaacaggcagttgacgatggccaaatctgtgacagtaaaacgctgctcgccttgttgtattggcagctgcaggaggggaattatggcagaggttaatacacgcaaagcataccgtgaggagcaggaaaaagcgcaacgagcggctcgtgaacgtgaagccaaacggattgaggttgaaaaggcctatgcgcggcagaaacggggaaagcctgaagtaaccgcagcccggtttgatgacgtcacttttcgtaaagtgaatagtctcaagaaacgtttgaattgggcaatcggtattgttgtcggtttgattgtgatcgtctttttggttttatactttgtctaacttagacgctgataagatcaggaaagtttatgatcagattcacgacattaatttaaagaaagaatgaggcgattttttgattaaggtcggggttatttgtgcgatggaagaagaaattcggacgttactggctaaacagactcatcagcaagaaacggtgattgccagccagcattactttgaaggccaaatagatggtgttgatgttattttggtacaatccggaattggcaaggtacaagcagcgatgacgactgccttgctgttagcgacttttaagccggatgttgttgtcaatactggcagtgccggtggtatcggtcgcggtttggcgatcggtgatgttgtgatttcaagcggtgtggcttatcatgatgcggatgcgaccgcgtttggctatttgccggggcagttgccacaacagccgcagatttttgaagccggcatgagttatgtgcgccagattcaagctgctgcgacggcgaccggcttgacgtcaaaagtcggcttgattgtttcgggcgatcagtttattaatggcaaagaggcgattgcccgaattttgaaaatttatccacaagcgcttgccagtgagatggaaggcgcagcggttggccaggttgccaaggaatttcacaccccgtttgttgttattcgggcaatgagcgatgtggctgatgagcagtctggggttgatttcgacaaatttgtgatcaaagcaggggagcaaagtgctgcgatgttgttacagttctttagtcatttgcaacgatcacagcataattaggagtgattgtaatgcaacacatttatctcgacaatgctgccaccacaccgatggctcctgaagtcattcagaccatgacggatcaaatgcaacatgattttggcaacgccagctcgactcactggtttggccgggaagctcacacggtaatggacaaaagccggaaagttttggcggactcgattcatgcccaacccggcgagattgtgatcaccagtggggcaaccgaaagtaataataccgctatcacccagacggcacatgcgcatgcgtcattaggtaaacacattattaccacggcgattgagcatccctctgtgttacagccgttaaaggcccttgaaaaagaaggttatcgcgttacctatttgcctgtggatgagaacgggcgtatccggttagctgattttgatgccgcgctggatgacgacaccattttggtcaccatcatgatgggtaacaatgaggtcggcagtcggatgccgattagtgaaattggtgcacggctggttgaccatcaagcctggttccacaccgatgcaacgcaggcgtatggcttgcttgatattgacgtcaacgcacaacacattgatatgctgagtgtttcagctcacaagattaatggtccaaaagggattggctttttgtatcgcgatccgaaagttcagttcccagcgcttttaaaaggtggcgaacaggagctcaaacggcgtgctggcaccgaaaatatcgccggaattgccggtttcgcttctgccgtaaagttgattacgcctgaggaaaaggctaagcgccaaagcaaatatctcggctttaagcaacagattatgaccgctctagatgatgcagaggtgccatatgcggttaatggcgatattcggccggacaatgtcaatcatgtgttcaatttgtggttaaaagggatttcgacttatgcgcttcaaacgaatctggatttagcggggattgcggtatctggcggatcagcctgcacagcgggatcactggagccatctcatgttttgacggccatgtttggcggtgatagtccgcgtttgggtgaatcaattcgcgtttcttttggcgggcagacgactgcggatgatatccaggcgtttattgatacgctgctgccgattattaaacggttaactgccaaacaaacgagtcggtagctttcggaaaagtaggcagtatcatcttgagactcgttagggcactgtgaagctaagcgatggaaaagaagacacttttcgggcaatcccgtgatgtgctaaacttatgggtagttaagcgtgttcataatgcacgtgtcttgcgttttacgctcatattaacgcgttctccagcgcagaagtctgcgtgtaaggacctcaggcgtgatggccaaagcccggccatcacgcctgaggccacttacactccgacttctacccgcgccggctcacgctcacattaacgcgttctccagcgcagaagtctgcgtgtaaggacctcagtcgcaatggccaaagcccggccatcacgcctgaggccacttacactccgacttctaaccgcgctggttcacgctcaggaggtttggtaatcatggctttagcttcaaccggatcggctcaaggggatcctaagacttatcgaattgggtccaacttaaaacgatttacgttaattgatttaggctttgttccaacgaagaatggtaattttcagcttcagcggtcgttggatcctaattcaccgtatacagcggcgaataaactgaagatgacggtggctaagacgctggacaagtttcagcttgatgtgaccacaggcaacgggcttaaggcaattaacattttcaagaatgacagcacgaaggaaaatgttgaacaatatgaatattggattaacaatttcattgaacgtggtgtgctcgagcctaaataagtctctttgaaaatcacggtaactttccttttaaacaagcggagattaccgtgtttttttgttgcatgaatcacggattaaagcgttacgactggtaaagcatgagccacatcacggatgcgtggttttagtgaggcgaatgtcgtgaccgccaaatcaagtgaccaaaagtggtaagctggaaacattgaaattttgatatgaaggagggcttgtatgtttgaacatgggtttattgaggtacatgatgccaatcagaacaatttacaacatgtgaatgtgaagatacctaaggatgccattacggtttttgtggggcggtcaggatcaggcaaatcatcgttagtgttcgatacgattgctgcggagtcacggcgggagttgaacgaaacttttccgagctttacccagcaatatttaccaaagtatggccagcctgatgtcggttcgatcgatcacttgccggttgccattgtggtggagcaaaaacgtatcgggaaaaacgctcgctcaactttagcaacttacacgggtatttactcactgttacggctgttgttttcgcgtgccggcaagccattcatcggctattcggacacattttcgtttaatttacctcaggggatgtgccccacctgccaaggcttaggttacgtggatgatattgacgtcagtaagttgattgatcccaataaatcgcttaaccaaggggcgatcacctttgtcagttttggaccggatacctggcgttggcggcgttatgcctacagcggattgtttgataatgacaaacccttacgtgactacacgcccgaagaaatgaaactgttgctttatgcaccccaacaaactctgaagcatgcaccggctaaatggccaagaacagcgctatatgaaggtgtcgtgcctcgcattaaacgatccattattggtaaaaaagaagcagaacatcataaggccgcactggcagaaatcgtaacgcgtaagccttgtccggattgccaagggacacgcctacgtccggaagtgttaacctgtttgattaatcaaaccaatattgcccaagtgctgcaaatggacttggtaaacgtacggcattttctgaaagccattcaagtgctgctggttcaggatgtgatccgggaattattacgcaaaattgatgcactgattgatattggcctcggctatctttctttagatcgacccaccgagacgctttccggtggtgaaacccaacggatcaaaatcgccaagtttctaaccagtgctttggtcgatatggtttacattctcgatgaaccaagtgttgggttacatcctcacgatatcgagctaatcaagcgggcactactgcggctcaaggaaaaaggcaacaccatcttgatcgttgagcataacccagcgctgattgcattaggcgactatattgttgaggtcggccccggtgctggcacaactggcggccacattacatttaccggcacttataagcagctgttgacgagtcaaaccttaaccgggcgtctgcttaaacagcgactgacatttcggcaaccgcgatcggctaaaacgaccatccatttgccgcatattacccgccacaaccttcaagatgtcgatgcggccatcccactgggcatcgaaacggttatctccggtgtggcaggttccggtaaaagtacgttagttgcggcgttacgtgatcatttaacggtgccgtacattgatctggcccaagcggatattggcgctaatatccgttcgacacccgtgacttatttgaaaatccttgatccaattcggaaagtatttgctcaagccaatcacgttggcagtagctggtttagctacaatggccgtggggcgtgtccacgctgcaaaggcaaaggggtcaccattactaacatggccttcatggatccggttgtttccgtttgcgaacagtgccatggcaaacgttacaacgatcaggcacttggatatacgtttcaaggcaaaaacatggcagatgttttagccatgccgattgccgcagctcagacattttttgcgcagaatcacgacattgccaagccgttagaaaatatggcgcgagttggccttgattacctcacgctcggtcagccgctgacgacattatctggtggggaaaaacaacgattgaagcttgcggtggaattaaaccgcactggcgaaatttacttattggacgaaccgactgccgggttgcatctacaagacgtcaccaaattactgcatttgtttgatgatttggtggcagcggggaactcactcatcattgttgagcataacttgcaagtcatcagtcaggccgattggctcattgacatgggaccggatgctggtatctatggcggtaagattctctatgctggcacgccgcaagctagtatggaggctaagcaatcgcgcaccggacaggctttgcggcaatataatgcagcaccggagcgtcagcccgattaatggcagcactttggcgcacttagcaggaagctcgcttgctatctgttcttggcctgctataatagcacttactggaattcgaccttcaaatcggatatctccagaatctgatgaaatgatggtgattgttttggacaattccaacacccgtgttgttgttggcatgtccggcggcgttgattcaagcgtcacggcattattgctgaagcaacaaggatatgatgttgtcggtgtcttcatgaaaaactgggatgacactgatgaaaatggtgtttgtacggccaccacggactatgaggatgttgctaaggtggctagtgagataggtattccttattattcgattaatttcgaaaaggaatactgggatcgcgtttttcaatacttccttgatgagtacaaagctgggcgcacaccaaacccggacgtgatgtgcaacaaggaaatcaagttcaaggcatttttggattatgccgagcagctaaatgcggattacattgcaatggggcactatgcgcaggttaaaaccgatgagcagggcgctgttcatatgttgcgaggcgcggacggtaataaggatcaaacgtacttcttaagtcagctttcccaggatcagctcaagaagtcgatgtttccaatcggtcatttgcagaagccggaagtgcgtaagattgccgaggcagctggattggcaactgccaagaagaaggactcaaccgggatttgctttatcggtgagcgtaacttcaaacaattcctgagcacctatctgcctgcccagcctggtaaaatgatgacggtcgatggcgttgagaaaggcacacacgatggcctgatgtattatacaatcggtcaacgtcaaggcttgggcatcggcggtaactcgcaaaactccgagccttggtttgtggttggcaaggatttagacaaaaacatcttgtatgttggtcaaggttttgacaacccagcgttgatggccacaagtctcagtgcatcgaatcttaattggaccaccggcgaggctccggctgatggcacgcatatgacagctaagtttcgttaccggcagcgtgataccggcgtgacgattcactatcatgatgacggaacggcgactgtcgactttgatgtaccggttcgggccattacgcccggtcaggcagtggtcttttatgatggcgaggagtgtttaggcggcggtacgattgatgcagcctatgcgcatactagtgagctgcagtatgtttagtgcgccagcaagttggcatgatgtgatgtaaggaagatcggtcccggagataaactttatctccggggccgttttgctttgtctggctgtttgggggtggggttattttgggttttataacgccgcggttggttggtcgggtttattctccgaaacgcgctcacagggccagaaacctgcacataaggaccttggacgcaatggccaaagcccggccatcacgtccaaggccgcttatgctccggtttctaagcggccctgttcgcgctctgtttccgaaacgcgctcacagggccagaaacctgcacataaggaccttgaacgcaatggccaaagccctgccatcacatccaaggccacttatgctccggtttctaagcggccctgttcgcgctcttgatattttgtccgaaaatactgataatgaaaaggttaagatgtgaaaaggggagcggcttgtgaccaagttatattttgtgcgccatggcaaaacagaatggaataatcagggacgttatcaaggtgcaaatggtgattcgccattattgccggagagttttgaacaaatcaaagcattggctgattatttgcgtggcatttcgtttgcgcatgcttatgtcagtccgctcaaacgtgcccgcgtcacggcccagacgcttattaaagacttaaatgaaccgattccgttgacgattatgccggctttgcgggagttcaatttagggaaaatggaagggatgacatttacggatgtcgctaagcattttcctcaggagttacatgcatttcggcatgaaccggcagcgtatgatccgcgtaaaattcacggtgaatcttttccacagttgattaatcgggccattccggcgattgtggctaccgtcgcgatggatcggaccggtacggctaatttgttatatgtcagccatggtgcggccttggcagcggttattcagagtctgcttggtacaccattggcagagattcgcaaagatggtgggctgacaaatagcagtgtgacgattctacaagcggatggtccgagtctgccatttaagttgctaaactggaatgaaacgagttttcttcccgagccaccgaagccaaccgacacgatttaatggttgcgactgcgatcatatcgcacactgaatgaagaggatgttatggattcaaatattttaaccgcatttaatcaaggaaaacacgaagaggcgattcaggcagccgttaaagcgattgatgctgatccgaaaaatcctaagcgttatgcggttttgacaacgatgctgattagtttgaaggccttggatcaagcaggtgagttattagccaaagcgcgggcactcttcccagatgacttggaattacagtacacagctggtctttttgcctatgagcaggcggattttccggcagcggctgcctggtttactaagtgtcgccaggatgatacgttaaaaaacgatgccacgtacatgctggcattgagctatcagcaagccggtcaacctaaaaaagcactggcctttgcattgacagcacacgaattggcaccgaagcaaacagatgcggcgttgctggcggcagatttgttattaggcgagcaagcttttgacgcggctgcggagattctgaagccgctgctggaagcgcggcaaccgcaagttttattcacgtacggcatggcgttgagtgctgcgggtaaagatggcagtgcctatttagatgcagccaaacagtttgatcctaaagggtacgatcaaaaagccggtaccgttgctgacatcaatcgcttcttacggttgcaggaagggggccatgatggacaggcatgaagatagcgttactggccgggtcaaaagtattttctttcagaatccgactaacttttttaaaatcctgctgattgatatcacggcaaccacgattacctggacggagcaggatattgtggtgaccggtacgttcggggatattaaagaagatgagacgtacacgtttaccgggcatgtcgtggaccatccgaaatatggccagcagtttcaagcggataattaccatgtggatcggcctacgaataaaacgggattgatcaattatcttagttccgacaagtttccgggaattggccccaaaacagcggagaaaatcattgacaagctcggagttgatgcgattgatcgtattttggatgaccctgagagcttaaaaggattggggatttcggcggccaagcagaagatgctggtcaccaatctgaagacgaaccagggaatggaacgggtcatcatcggccttaatgactacggcttcaccagtaacatggctggccgaatttatcagcaatatcaaaatgatgcgctggaagtcattaagcaaaatccgtatcagttaatcaatgatattgacggtatcgggtttacgcgggccgatcagattgccgccaagttagcgattgccccggattcgcaactgcggctcggcggtgcggttatggataccttacagcgtttgacagacggtgaaggcgacacttttgtcgagttaaaaacgttggtcacccagacgcttgatttactggagcgagcgcgtcaggttgcagtgaaccccgaagcagtcggccaggcaatcgtcactttagccaaggacaatgcgctggtagcggaaggtaagcgcatttttcctaaacgactttatgattccgaatggcagattgcccggcagttaaaaggactggcggatgccgggagcgctgccaagcaacctgcactggccgaaattaaacaaacattggccgccgtacaggaagagactggcattgcttatgatgaggtgcaaaaaaaggcgattatcactgccttgcagtcgccgatttttcttttaaccggcggccccggaaccggaaagacaacggtgacggacgggattgtccgcacttatgcgcaattgcatgatttatccttagatcgtcacgaatacacgccggacgatcctttcccgattatgctagcagcaccgactggccgggctgctaaacggatcagtgagacgacacagttaccggcaagcacgattcatcgactattgggattgggcgtggatacgcaggagtttgcgcctaatgatctcccggacggccttttaattattgatgaaatgtcgatggtcgacacgtatctttttcgaacgttattgacggcgctgcacccgggtatgcaaattgtgttggttggtgataaagatcagctgccaagtgtcggaccgggacaggtttttgctgatttgttacgcagccaggctttacctcacgcagcgttaacccacattcaccgccaggacgcggacagttcgattattccgttggcgcatgcggtcaatgccgggcgcttgccggatgacttcacccgcccgcaagtggatcggagctttttgccgtgctctcccagtcaagttccggaagtggtcgggcaggtggttcagcgtgccgcggttaaacagttttcgattgcggacattcaggtgcttgcgccaatgtatcgcggaactgcggggattgatcggttgaatccattgttgcaggatattttgaacccgaaacgcagcgctcggacaaaaaccgttcattttggcgaaaccgagtatcgaattggcgataaaattctccaattggtcaacgatccgaatcaaaatgtgtttaatggcgaaattggccagattgtcgggatcacacttgccaaagaggcggccagcaaaaccgatgagttgacgattgattttgacggcaatgaaataacgtataaacgcagcgacttcagcaaaatcaccttggcttatgcgacttcgattcacaaagcgcaaggtagcgagtttccaatggtgattttgccattaaccatgcagagtcgccggatgctgcgccggaacctactttatacggccattacccgggcaaaatcgtttttgattctggtgggcgagctcgctgcatttgagaccgcagttggcgaaattgcggtaaatcggcatacgggtttagtccagcggctgcaacaagcgtttggtatgaccgtttctcagccggacgtagaaaagccgacgcctgcaactgaagtcagccagaataccggacaaattgacactaacccgtctgacttggataatggaattagtactgacgaatcgaacaattatcagctaacccctgcattggtggcttcacagcggattgatcctatgattgggatgaatggtgtgacgccacaaatgtttatgacgaaggagaaataacctttatggaggacaacatacgcaagtcactgcaaattaaatcagtgacgcctaaggatcttgaacagttcaacgaccttttgacttatgtatttcaggtcacgcaaaaagatctggaacaatccgggtatgaagaaggggaacttgaacgggccaagcgtccggttttggaaaagtcggacgtattgggatggtttcatcaaaatgagctggtcagttcgctggcaatctatccgtgcaccgtcaatattcacggtaccttatatcagatggctggtttaaccggagtcggcacctatccggagtacgcggggcatggcttaatgcacgatttggtgaagttaggcttagagcacatgcggcaacataagcaatggatttcctatctgtacccgtatagtattccgttttatcggaaaaaaggctgggaaatcatgtctgatcatctgacgtttgatgtgaaggatacccagttgccgaaacaagtcgaggttccgggtcacgttgaacggctggagatagatgatcctgatgtgattgaaacttacaatcgctttgccatgaaaaatcacggtgccatgattcgcaatcagctaaactgggacgaatactggcgttgggaaaatgaagaagaacgaacagccggcgtgtattatgatgccaacgacgaacctcaaggctatgttttatactggattgccgatgaagtttttcacgtcaaagaaatgatttataccaatcaagaggcacgcgtgggtttgtggaattttatcagtgcccacttttcaatggtgacccacgttaagggcaatatctataaaaacgagccgttacattttcttctggacgatggcgatatttatcaaactatcaagccgtattatatggcgcgaattgtggacgttaaagcatttttggcacaatatccgtttgctgccgagaccacagaaccgtttcatttcgttgtaagtgatcccttggcgccgtggaataatgggacatttggcgtttattgggatgagcatcagcaggtaaaaattacgaaccgacctgttggcgaagcgattacgacggatattcaaaccttgaccacgatgttaatgagttaccggcgcccatcctatttagcccaaatcgagcgtttatctgctagcaaacatgcgatcaagttgttggagaatgcggtaccgatggaagaaccttatttttcagactatttctgatcggtatttcgaaaatttgtatgctgttgtcaaagcctgcacgtgatgggttttatgtgataaaagcgaaaaagcctcagactgatttttgtctgaaggcttttttaattggaaactatttaaaaaggttaaatactacggtcaatccaaaactgttgggaggccaccgaaaaatcaatttcaaacgggcgtgttcccatttcttcaccatccatttggccaaattccagtgaactggtttcaaccgtcaactttttagcgtgaaaaagatgtaccgcgcgacttgttggagccttgccacgcatgagttgaatcatcgcgaatgcccaggacacgatattaaaccattcgacaatgatcaaatcaagatgcccatcagtcgggtcggccggcttatagatttgaataccaccgccaaaataggggatgtttgtcgtcgtgcaaatataggcgcggtgaaaaaaatgccggacgcctttttcatacaccgcaaccggaaacgggcggcgggttagcaaactcccaataacgtgaaacaagtaagttaatttaccgagatgaaatttatttagcagctgtttactatcgctgtgattggctgcactgacaaccgctgcatcaaagccaatcccgatattattgacaaaataaccggtttcatcacgagtacgttcatgataacggccaatatcgattgcaaccggtttagtggcttgcagtacctgttctagcgcgtgcattggatcttccgacatcccgataccgcgagcaaaatcattacctgatccggccggtacataggcgacgggcagatcgtgctgccgggtaccgattaaaccgttgatggcttgatttaatgtgccatcgccgccgatcaccagtaaaatagcatggtcgcgggtattaaaattaccaatttgcttcgcgatgatattggtatgaccgggatagcgggaggttttgattgcataaggcaattggcgttgatctaagacggctttaacctgtttaaaaataggaattgctgctccgccacctgccgccgggttatagatgagataataaaaaacagccgccatcaactttcctcctaattagacacgcaatcaattataccgaaaaagccaagaaaaacaatattaccgtcatatttgaatagcatgttcgccaatagaagtaaacttaacttttcggcaaagccggcgtaacggtcagggggcctttcaaaaagattaacgtttaaatggcaggttaaaaattgcaaaaaaacaccgcacagcttatatggcaagtgcgatgtgagaataaacatttgagattgtgaaggctgctatagcagaatcagcatcggtagaataaccggatgacgttcggttttatcaaaaaggaattcctgcaagctgctggtaatcgcatccttcaaggtagcttcggtgaccttttcattatttgaaaaagttgatttgatagtgcgataaacccgccgctgagcctggttgatcagttccccggattcacgcatgtagataaagccgcgagagagtaaatcaggaccggccagcaccgcttgtttttgcatattgatcgttgcaaccacaacgaccaaaccttcttcggataacatgcggcgatcgcgaatcacggcattaccgatatcaccgacaccgctaccgtcaatgtagacgtcaccagcagggaagtgtccggcaattcgcgcacttttttcggttaacgccagcacgtcgccattttccatgatgaagcagtttttctctggaaccccgcattgttgggcgagttcgcagtgaattttttgcatccggtattcgccgtggcaagccatgaagaatttcggcttaatcagacgaagcattaatttttgatcttcttgaccaccatgtccggacgtgtggacgttgttgaccttgccgtgaatcacttctgcgccggcttcgcttaactggttgatcacgtgattgacgctgaccgtattgccgggaatcgggttgctggagaagatcaccgtatctcctggttgaatactgatctgccggtgagttccgttggcaattcgacttaacgcagccatcggttcaccttgcgagccagtacatagaatcattactttatcggctggcaatgaattcagttgatgtgcatccactaagacgtcatcgggaatattaaggtaacctaactcacggccattcaccattgccgtttccatagaccgtccgaaaaccgcaatcttgcggccatgtgccattgctgcatcggccgcttgagcgatccgtgaaatgttggaagcaaaagtggcaaaaatgatgcggccatcaatgcgatcgaaaatatgtcgaatcgatttgccgacgaaccgctctgattttgtaaaagtcggaatttcagcattggtcgagtcagacatcaagaccaaaacgccttcttcggcgaaccggcacattttttggaaattcggtgatggctgatccccaaccggagtcaaatcaaacttgaagtccccggtttggatgacaattccttgtggcgtatgcaccgcaatcccgagcgtatccgggatactgtgggtggtacggaaaaattcgacacttagctttttaaacttcaaaaccgtgtcttcgttgatttcagttaactttgtggtccgtaataacccatgttcttcaagtttgccgcgaatcaacgctgccgctaatgggccggcatagatgggaacgttgggcacttgctgaagaaaatagggaatcccgccgatatgatcttcgtggccgtgggtgatgaccaaagccttgatcttatctttgttttgaaccaaataagagtaatcggaaataacataatcaatcccaagtaaatcgtcttcggggaatttaatccctgcatcaatgacgatgatctcatcttggaattgaaccccgtacatgttcttcccgatttcacctaaaccgccgacagcaaagacggcggtttcgttttttttaatatttaatttcatatgattagaaagtggtcagcttgaaattggctgacttttcctcatactccaggaaatttccagaaagttcctgaataaattcaatgttgtaaggcgtgttggcttctacaagcgcacgcgcctcaaccgcagatggcgcctcgaggtaaagcgtctgagtggtttcccgtcgcggattttggatcttgtctttttgatataagactttgtagatcatgtttggactccttccgtggtacaaaaagaaaggaagtgcaacaaaacagcttccgaaaaaaaggacatgccatcaagatgacgaaccacaaaaagcatgggcgatcttgctggaatggccgatgtttcgtcgcttgaaccgcaaaatggcaacataacaccgttgccgtggtccatttcctgccacaactcctaaaacttttatgaccgatcgatttgttgtgaatacaacagctaggcatagtttagcatatttaatggagcgtgaacagcttacgagcatcacagacgtgcctgcgggagaatcaggtaattgtggcaagaaaagtttaacgtacttggtcgatacctcgatcttagctggatggccccggctgccaggttttatagtaccgaggagctgcccttttaagtagcaatggtgagttaattgctgaacttaggtataatgagaataggcacgttcgcagaatcagcgtgaaaggggtggatgccatggtgtggcttctgattgttgtactgcttgttgtgcttgccattctttggctattcagaaaacgttggcggcgaaacaaggcgattcagatcctgctctaccacagccaacgattaaccgatcaggcgatggcagaggcgttacagcagcttggcatctcaactgacaagccgatgacgtcaaagcccatcgccgatatttgggggcatggggtgatggcattttcatatcaaatttcgtcaagtctggggaaagtcacccagccggcacttgagcaagctttgcgccaagcagccaggcagttagacattgccagctcagacccggcattgccaccgtttgttttaaccgatttttttgaactcgaaggcgaattacatattgatgttgcctttattactaacgaggcaaccattgaatatgttcgcgacgttaatcgggtgtcgtcataggcagataaggagctcgcgcgatatgaatgatgatcaggacttaatcatgcgttaaatcaaaagctttgctcagggattaggcgctgctttaggcaaaaatcaacgcaaatcaaaccaacccgtgatcgtttttcacgaagcagaagtgagtctggccagttatcaaaaaacgctcatgaatgtgattcgcgaaaaagggttaatcgcggcccaagcacaattgaaaaagtggcaacagacaagattgtctgctcaccaatatcagcgtttaaatgcgtggattcaagaacagcagttaataaaaaatcgtaatccggacaagtaaaaaagcagcgagtcgttttataaggctcgctgcttcattatttaatggatcagaaccgcttccggatcaatcgagaagggatgttccttgttaatgtggtcatagaataaaacgccattgaggtggtcgatttcatgttgacaaacaattgccggatagtttttgagtcggacttttttgtgttcgccggcttcgttttggtaagcaatcgtaatgcgatcggcacggacaacgtaacccggaacatctttatcgaccgagagacaaccttcgccttcagccaatgcggcatgttgcacactgttactaataatccgcggattaattaaaacttctttgaagagaatttcatcgttgtctccaggaaccaagacagcggccattgctttactttgaccaacttgcggcgctgccaagccaacacccggacgcaaatgatatttctcgttttgctcttcgtcttgactgataaccaagtatgccatcatatcatgcgccaattgcttatcttcatcggaaagcggaaaagtaaccggtttggccctttctcgcaaaaccttagcgccgtcacgggtgatatccttcattaaatacacgatccgtacctccgttcatttcttctactagattagcacaggagcgaaaatgtgaaaagcgcgttattacgttagagggttggtaagcggggataaagcagcttttgtttcgccttcttactgcgtggcttgcgtgcagaaaaaacgtgtttgccagtgcagaagcctgtatataggggtcttgagtgcaatgggcaactcaagacggcttaacattctagcttacgcccataacactcttgacggcgcagaaaccggcaaatggggccttgagcgcaatggccaaacccgggcgacttatattctagcttatgcccataacgcgttcgcaggcgcagaagtctgcgtgtaagggccttggacgcaatggccaaacctggggaacttacattctagcttacgctcataacgcgctcgccagcccagaaacctgcacataaggaccttggtcgcaatggccaaacccgggcgacttatattctagcttacgctcataacgcgctcgccagcccagaaacctgcacataaggaccttggacgcaattggcaacccaaggcgacttacattctagcttatgcccataacgcgctcgccggcgcagaagtctgcgtgtaaggaccttggacgcaatggccaaagtacggccatcacatccaaggccgcttacactccgacttctaaccgcgccggctcgcgctcactttctgttagtattgacatcccacttttaatccgttattataaacaaggttcaacaaatacggtgctttccgttaggtgaggctcctatacgaacaatgctgctgctcagaaacatcgagagatgccaattgagtcaactgcgtctgcccattaaggcttacgctaatgcagctgaagctcgcttctaggcgtatagtgctaaaactaaacgattgggatgctttttctgcacgctctcaatcggcgtgcagtttttttgcttgatggaaagaaaaaaggtggtgagcataatggaacaatcttcaaagagtagtggtagtagtagcgatttagcagatcccggaaggcccattatgctgccactacgatctcttaagtgaaattaatggattcggcagcatcgcggctcttcccgggatacgggaaggagtttgtcgatgttgatgatggtatcaagcggtctgacacgctacgaagcgcagaaggcccaaaaaacaactaccatacgccaagaaacgatcagcaagacgaatctctttttgcccttgctgatgacattggctggtgtgagcagtttaatcttggttatgagccacagttggcttttaactgctattgttgcgattttggctagtttgacggtgatggtcattgcttatttggcaaaagcaatcacgcgccatcaaggtcagccgcagcagccagtgttggtcgtgcgtgacggattggttcgtcaagttcgcgcgcaagatctcgttgttggtgatgttttaatgctgacagcaggagaaaagctgccggttgatgttgcattagctcctggtgcatccgtaaccttgccacgtgacctggccgggctgctgattttgttaaatcggcgggtgccaaccggggtgggtattgccggtgctgtgatggcaaccgatacccaggcaacagtgaccgcagttttaaatgacggattgcttgatcatggactcaagcaattggctggacaatctgttacaacaacgccaacttcacttgtaacgagtgcggttgccggcatgaaattggtcttacaacagatttgccgaattttccgtctggctgtatcagttgcgtcacttgaaatgttaaaaaataagcaaatagaccgagacgagcagattcgggtagagatcgcatttgctcatcacgctaccttggttggggctatgaaacatcacagtaaaaccagtgattttcggcacaaccaagatccagtctcgtgaagcttggtcattaaattcaattatgaaagcatgcgcttgtgaaggcgcatgctttctttgtgttttagtttaacaagtattctgttatagtccattaagctttcgaataagtggcaatcttatcgcaagtcagttcttgctcaccttgaaataaaacgcttgcaacgagaattttgcaatgttacgctttctttgtaggagttttaattagtacagttttcctgagttaatgactacaggaatggaaagaggttctgattatggcaaaacagcatgctgcagttgattttaagcaactgttggacaatcaagatgccgattttaagcccacaatccaaattctggatgaagttggtaaagtcgtcaatcctgatattatgcccgatttgagtgatgatcagctggtcgatttgatgtcaaaaatggtttggcaacgcgtgctggatcaaagggcgacagcgttgaatcggcagggacgattaggcttttatgccccaagtgcaggcgaagaggccagcatgatcggtagtcacgctgctatgaagtcatcagattggctgcttccggcttaccgtgatttaccgcaattgattcaacacgggttaccgcttgacaaagcttttctctggtcgcgcggtcacgttgccggcaatgagtatccggaagattttcacgcattaccgccgcaaatcattattggtgcgcagtatgttcaaactgcgggtgttgcgctcggtttgaagaaaaatggcagtgatgaggtggccttcacctatacgggtgatggcggtacttcacaaggtgacttctatgaaggcgttaactttgctgggcatttcaaagcgccggcactgtttattgttcaggataacggctttgctatttccgtgccgcgggcgagtcagacggcagccaaaacgcttgcgcaaaaggcggttgcagccggtgttcccggcgtgcaggttgacgggatggacgctttggcagtctatgaagtcaccaaggaagcgcgtgcatgggcggctgctggcaatggaccggttttaatcgagacgttgacatatcggtatggcccacacacgctatcaggtgatgacccaactcgttatcgctccaaagagaccgatgagttatggcaaaaacgagatccgttaattcgaatgcgcaactatttgaccgataaaggcttgtggagcaaagacaaagaagatgccttgattgaaaaggtcaaggatgaaattaaagatgctatcaataaggccgataaagcgccgcagcagacggtatcgcgcttcttgaaagacacctatgaagttgccccgcaaaatgttgctgaacaactggcagaatttcaaggaaaggagtcgaagtaaccatggcacaaaaaacaatgatccaagccattaccgatgcgcttgatgttgagttggcgaacgaccctaagaccttggtattcggcgaagatgttggtaagaatggcggggttttccgggcaaccgatggcttacaggccaaacacggtgaggatcgtgttttcgatacaccattggcagaatcaggcattagcggtttggcaattggacttgccttgactggttggcggccaattccggaaattcagttctttggtttcgtttttgaaacgatggatagcattggcgggcaaatgtcacgtatgcgctatcggatgggcggaacacggtccatgccgattacgatccgggcaccgtttggcggtggcgtccatacaccggaaatgcatagtgataattttgaaggattgatcgctcaatttcctggtatgcgggttgttattccaagcaatccatatgacgccaaggggttactgatcagttcgattcgcagtaacgatccggttttgttcctggaacacatgaaactttatcgttcattccggcaagatgttccggatgggacttatacggttccactggacaaagcggcggttacccgcgaaggcactgatgtttcgattatcacgtatggtgcgatggttcgtgaagcgcttaaggcggctgataatctggctaaagatggtattaacgctgagattgtcgacttacgaacgatagcgccgcttgacgttgacacgatcattgcgtccgtcaaaaagacacacaaagcagtcgtggtccaggaagcacaacggatggcgggagttgccgccaatgttatcagtgaaatttccgagcgggccattttatcgcttgaggcaccgattggtcgggtcgcggctccagataccccattcccatttggacaagcggagaatatctggttaccaaatgctaaggatatcgaagctaaagttcgggaaactgtcaatttctagagagaagaggtgccaacatggcttttgaattcaaactgccagaacttggcgaaggtttggcagaaggcgagatcgttaagtgggacgtgaagccaggtgatgacatcaaggaggatgacaccctgcttgaagttcaaagtgataaaagtgtcgaggaaattccttcaccggtttcagggaaaattttgaagattttagtaccagaaggtgaaaccgcaactgttggcgaagcgctggttgatattgacgcaccggggcataatgatacgccggttgcatcgggtaccgctgcagcaccccaagccaatacggatacggctgcaccggccgcggcaccagctgctgccggatcagtaccggccatcaccgatccaaatcgggaaattctggcgatgccgtctgttcgccaatatgcacgcgaacaaggcattgatatttcacaagtgccagcaaccgggaagcatgggcgcattaccaaagccgatatcgatgcctttaaagcaggggcacctgctgcagcgcctgcgcagccagcagcaacctccgcgcctaaagcagcgcaaccagctccagcagcaacaccggcagcgccaaaaccgcagccagtcgcgccttacgtttcgaccggcagtgaagccgagctggagactcgcgagaagatgacgccaacgcgcaaggcaattgccaaggcaatgttagcctcgaaacaacggagcccgcatgtcacgagctttgacgaggttgaagtgtccaagttaatggcgcatcggaagaagtacaagcagtacgcggctgataaaggcattaaattaacgttcttgccatacatcgttaaagctttggtcacggtattgcgtgaatatccagaatttaatgcgtcaattgacgacaccaccgatgagattgtttacaaacattactttaatatcgggattgccacgaacacggatcatgggttatacgtgccggtcatcaagaatgctgatgccaagagcatgttcgaaattgccaaggaaatcagtgacaatgcacaaaaggcatatgacagcaagttgaagccagatgaaatgcgcggcggttccatgaccattagtaacgttggttcaattggtggcggctggttcacaccggtgatcaatcagccggaagttgccatccttggtgtcggtaaaattgctaaagagccatatgtcaacgctgataatgaaattgttgtcggtaacctgttgaagctgagcttgagttatgatcatcgcttgattgatggtgctttggcgcaaaccgcattgaatctcatggataaattgttagcagaccctgatctgctgttgatggagggataagcatggttgtaggcgattttgcaatcgatttggacaccgttgtgattggctctggctcaggtggttacgtagctgcgatccgagcagccgaaatgggtcagaaggtaactgttatcgagaataccttcattggcggggtttgtttgaatgttggctgtatcccatcaaaagctttgatcaatgccggtcaccgttatcaagatgccttggaagcaagcacgtttggtattaatgccaagggcgcggatcttgatttcaaaaaaacccaggattggaagcaaaacaaggttgtgcacacgttaaccagcggtgttgcgatgcttttaaaaaagcacaaaatcgaaaccatcatggggacggctttcttgaaagatgatcatagtctgcgggttatgcaaaaagactcggctcagacatacaccttcaagaatttgatcattgcaaccggaagccggccaattgaaatcaaaggcttcaaatttggcaaacggattttggattcaaccggtggcctaaacttaccggaagtaccaaaagaattcgtggtgattggcggtggctacatcggatccgaactggcgagcgcctatgccaacttaggcgcacatgtcacaattcttgaaggcaccagctcaattttgccaaactttgaaaaggatatggttcaactcgtcttgaactcctttaaaaagcgcggcgttacagtgattaccaacgcgatggcgaaggaagccgaagataccggcaatggcgtcaaggtaacctatacagcggacggtaaagaacaaaccattgccgcagattatgtgatggtcacagtcgggcggcggccaaataccgatgatttgggcttagacattgttggcattgaaacaacggatcgcggcttgatcaaagtcgatgcgcaaggacgaaccaataagcctaatatttttgcaatcggtgacattgttcccggtgctgcattagcgcataaagcaagttacgaaggtaagatagcggctgaggcgatcagtggcaaggcaagcgcggttgactataaagcaatgccggctgtttgtttcacggatccagaactggctacaactggcatgacgcttgctgaggccaaggataaaggcattaaagctaaagcaagcaagtttccatttgcggcgaatggccgtgctttaagtttggcgcaaaccgagggcttcgttcgtctggttacggatgaaaacggaaccgtcatcggtggtcaagttgctggtgccggtgccagtgatttgatctcagaattaacggtcgcggttgaaggtggacttaacgctgaagatttggctttgaccatccatccacatccgaccttaagtgaaaccattatggatgatgctgaagttgcattagggttgccaattaatatctagcaagtagattcatattgccaacatgatgcactgttaaggtgggtatcgacaactgattgtccgtgcccacttttttgatgggaaagcacaaagtcaaaaccgaaagtgcgagtgtaaggacttcatgaaaaaggaccaatatttcagttagttaacaattgcaaaaataaccctgtttaattttgtcttaagattgcgcttccgctaaaatatagataacgcagctgagaggaagggttttcatgcaaagagtcgtggtacatggtgccagcacggggacacaagggcttttacaaatgctgattatgtcattgcttgatttgcaagtcggctgttatgaacctgatgaaacattggttgacgtagccgggttgacggccttgagtcaaatttgtcacaatacgtttgtgaaggtgacgcccaaagttctaaaggcagccgatgttttgattctgactgatacagggacgccagcggatgaggggtttgtagccactaatattacggccattcggaaagtgctaaattcggcaatggcagcagggtttaagggtcgcattatcgttgccatgacccatgacgagcttttcacctatttcgctcaacgattttccggtttgaataagcgtcaggttgtcggtttaggtacttttggtgcaacctggcaatttgaacaatttctagcagagcggttggctgttcctgccgctcaagtgactgcctatgtggtcggaaccagtcagacgccggttctggtttggagccgagcctatgtaggtgccacgccggtgttgcgcctactggatgaccagacaattttttccgaggctgtgaaggcggttcagactttcttagccagtacgttgaccgtgatgcttggcaagttggttgaaccgatcctagctgcttttgccggtgatggggtgataggcacttttacccacttacgcgatgccgatgatggtacaggacagattagcagttcgccggttttattggatgaacgcggggtggtgacgttggcgatggtggcaggttccgatgatgaagaagctgccttaagccaagcgattcaagcagcccagacccagattgaagcgatcgaacaaggagcaaataagaatgaaagctaactatcattatcctttagatctcgattggaccacggcagaaaagatcaaagtgaccaccttttatgcactggtcgaggatgcttatgagcatggggttgatcgggataacctacttgctgcctataagggtttcaagcaggtcgtaccggataaaggaaccgagcgtcaactggggcgtgaatttgaaacactctctggttactcgatgtacacggtcgtacaaatggcacgccaaggtgtgagtcaaaagattagggtgagggtgagttaaacatgacacaagatccagaaaagatacgtgagacattgatcggttggtttgctgctagccggaaacgcattctgacagcaatggcacagccacttgatgttgcccaaaaaagcaatcgtaatgacctggtcaccaatgtcgataaagccaatcagcaatttttgattgaacatatcaagaccgattttccaacggcgcgaatcattggcgaggaaggccacggccatgatgatacggatcttaatgggttggtcttttttgtcgatccgattgatggcaccatgaattttgttaaacagcaggcacattttgcggtgatgatcggtgtctatcgtgatgggcaaccgattgtcggggctattatggatgtgatgcgcaatgaagtgttgagtggcggtccgaatctaccagtcacgtttgccggccgtcagttgaagccattgctggatctgccactgaaggacggtttgttgggagtggcaggacccatggctatcaagaatcgcttgcatttaggtgatgtggccttagctagttccggtgcgcggatgagtggtagtgccgggatggaatttattgaagtcgccttaggaaggcaagtcggctatgtttcctatctgcagccttgggatgttgcagcaggcatggcgattacgcaaggcttgggcgtcgaatttagtcgggaagacggttcggcaatcaacttaagtcagccaggcgttgtcgtggcagcgactccgcaagcacatcaaacgattctagccatgatggccggtaaaagtgaacaggcgcattaacgccgctcattaacgagcaacctcaaaaactggcggagacgattcccgtcagttttttgaatgtatggcctagatgcacggattccaaagaaaattccatcaaatcattcgcgtgaatcacttcacttttcagaaaactcacacagattgggtagaatgtgttataattcaaaatcgtataactgtgtcagttgctggcacttttttaatgcggtaagcggccagtagtgccagcagaaaggaagtagaaacgtgaaaacacgtgacgatattcgcaacattgcgatcattgcccacgttgaccatggtaagacaactttggttaacgagatgcttaaacaatcggatacacttgatcaacacattcaattacaagaccgggcgatggataccaacgccattgaaaaggaacgcggtattaccatccttagtaaaaatacggcggtgaaatacggcgacaccaccatcaacatcctcgataccccggggcatgctgactttggtggtgaagtagaacgggttatgaagatggttgacggcgttttgctcgttgtcgatgcattcgaaggcccaatgccgcaaacgcgttttgttttgaagaaggcgcttgaacagcatctaacaccgattgtggtcatcaataaagttgaccgtcctggtgcgcgtcctgaagaagtggtcgatgaagtgcttgaattgttcatcgaattgggtgccgatgatgcgcaattggaatttccagtagtttatgcttctgcggttaacgggacttcaagtatggattccgacttatcaacccaaaagcacacgatgaatccgctttttgataccatcatcaagacgattccagcgccaatcgataacagtgacgaaccattgcagtttcaggtggccatgttggattataacgattacgttggtcggatcgggattggccggattttccggggcaagatcaagatcggtgacaatgtaacggttatgaaactagacggttcacaaaagaatttccgggtcaccaagctctttggtttcttcggtttaacccggaccgaaatcaattctgctaaagccggtgacttgattgccgtttcagggatggatgacatctttgtcggcgaaaccgtgaccgctgcggatacgccagaagctttgccaattttacggattgacgaaccgactttgcagatgatgtttgtggctaatgacagtccttttgccggtcgtgaaggtaagaacgtaacggcgcggaaactagaggaacggttgaaggcacagctgcaaaccgatgtctcgttgcgtgttgacgatacggatcaagccggtgcctggatggtatccggtcgtggtgagctccatctttccatcttggttgaagagatgcggcgtgaaggctttgaattacagcttggccggccagaagttatctatcgcgatattgatggcgtgacgatggaaccgtttgaaacggtgcaaatcgatacccctgagcaatacaccggtacggttattgacgctatgagccaacgcaaaggcgaaatgcagaatatggaaaatgaaggcaacggtcaaacgcggctcactttccttgctccatcccgtggtttaatcggctattccaccgagttcctatcttctacaggcggttatggcatcatgaaccatacgtttgaaaagtatgcgccagtgatcaagaactgggaaccgggtcgtactcaaggcgcgttggtatctatcaatgccggcactgcgactacctacagtttgcaatccgttgaagatcgcggccaactcttcatcaatgctggcacggaagtttacgaaggcatgattgtcggtcaaaactctcgtgaaaacgacattgctgttaacgttactaagggtaagaacctgacaaacacccgtgctgccgggaaagaccatgcagctgccatcaagacgccaaagaagatgacgcttgaagagtcgattgagttcttaaacgatgatgaatattgcgaagtcaccccggaaaacattcgcctacgtaaaaagattttaaacaccggcgaacgtcaaaaggctgcaaagcgtaagaagattgctgcttctaaataatttttaaaaaagtcgtcaagttattggcggcttttttgatttcaaaaattaagccctcttcaaaaaatatcttaaccaccgtagacaatgaccttaatgataagcaatggcaactttgaggcttttttcaggactttttctgattaagacaaactaaacttcctgatacattccagcagcagtgcgatgggtcaccttgttcgaatattaagatagaaagcaagagctggcggagcggtggcgggctcagtggtgaaattggtcttaagcggagtgggcttctccgctttagaccaaggccgagcttcgaaaccgcggtctttgcgggttcgaagtcgtgcccaccactctagctgcgcggtcgccagccgccaccaccgcggagccagctcggagtaacggaaatcacttaattagagtagaaccgagaaaaagttgacacttaccgattgccagtgcggcttggcggtacgagccggtatgctataattaacccaatcattgcttgaaaggccgcgttttcctaatgaaaaaaatacgccatgtggattatttcatcttggtgccgtatctgattttgtgtgcgattgggatcgtcatggtttattctgccagcgcctattgggtacaacgtcaatatggcgccgccgaaactaaatacttagttcagcagattctttttgtgattcttggcatcggaacggtattcttcttttataagatgtcactcaagattttacgtaatcgctgggtgctttttattttgatgagtaccttgctggtgttgttggtttatttgatcctgcatggtcgtgcggtcaatggggcatcggcctggattacgattggcggttttcgattacagccatccgagtttgccaaaatgattttgattttttatttagcgcacatgttgtcatcgcgtgaaaacagtttccagcaagaaaatttccggttacaccaaatgtggcagccgctgtttatggccggcgtcatcatgtttttggttttcattgagccggacactggcggatttgcgattctcttcttgattaccttggtcgttgtgatgtcaagcgggattcccatgcgttatggactgctctgggtgttggggttgattgcaaccggcgtcttagggtactacattgtgtcacattaccattttgccggtcttgaaaataactatgcctaccagcgactggtagcggcgattcacccgtttgagaaagccaatgctgcgggtaatcaggtggtcaattctctttacgcgatcaatcatggcggctggttcggagtcggcttgggaatgagcagccaaaagctgggttatctgccggagccatatactgacttcattttggcagtgattgccgaagagctcggattggttggaaccgtggtcatcttaagcttattatttttcttagtgatgcggtttttcttaatcggggttcggtctaaaaatacgtatcacaccctgattgcttatggcattgcgacgatgatgctggtgcaaaccattttcaacgtgggtgcagtggcaggcgttatccccgtgaccggtgtgacattgccatttattagttacggcggatcgagtatgatcgttttatccatggcagtagggattatgcttaatattagttatcacagcgaacgtacgcaacgaaaggtagagaagacgcatgcataaagttttagtcgcaaatcggggcgaaattgctattcggattttccgtgcctgtgaagaactgggcctaaaaaccgtgggcatttatgccaaagaagatgctttgtcgattcatcgctttaaggcccaggaaagttatcaggtgggagcaggtaaggcgccgatcgctgcgtatttggatatggatgacattatccggatcgctaagcaaagcggggcggatacaatccatcccggttatggtttgctttccgaaaatgccacctttgcgcgaaaagtacgtgcggccgggctgacgtttgttggaccgcgctcggaactattggatgtgtttggcgataaggtagcggctaaggaagctgcccacaaggctgggttaacgaccattccgggaacaccggagccaacgcgtgattttaccgaaattcaggattttacggctaagcacggcttcccggttatgttaaaagcggcaagcggcggcggtggtaaaggcatgcgaatcgtacattctgaatccgaattagaagccgtttaccaaaatgcggtcaatgaagctaaggcaagttttggcgatgatcggatgtatgttgaaaaatatattgcgtccgccaaacacgttgaggtacaagttctgggcgatgaacatgggcatctattgcacctttttgaacgtgattgttcggttcagcgccggcagcaaaaagttgttgaaattgcccctgctgtggctctgccgttagcattaagaaaccgtatctgtcaaagcgccgttgatttaatggccagtctgcattatgaaaatgccggcactgtcgaatttttggtcgatggcgatcagtattactttattgaagttaatccacgtgtgcaggtggaacataccatcacggaattgattaccggggtcgatattgttcagtcccaattgcgcattgctgccggggccgatttatttgcggacctgcacttaccacagcaagatgcgttacgggaaaatggggcggctattcagtgccgcattacgactgaagatccagaaaataacttcatgcctgacaccggcacgattaatacttatcggtcaccaggcggctttggcatccggcttgatgttggtaatgcctatgcgggtgccgttgtcagtccatattttgattcgttactggttaaggcaagtgtccacgcacctagttttcctgctgcagtggctaagatgcagcgcgcgttacatgagtttcaaattaccggcgtcaagaccaacgtcgcctttttggaacatttactggcaactcagacattccggaccggtgaggcagaaacggcctttattgatgcgcatccggaattattacaagtgcaagcgaaaccagatattgcatcccggttgctttggtatatcagcgatgtaaccgtcaacggctttaaaggcgttgaacgtcaaagccaaaagtactatccggagttgcaatatacacgccattttgctgctgctaaaccgcagacggatttggtggccctacttaaaaatgaaggtgcccaggcggttacggattgggtcaaggctcatccagcgctgcttttaaccgatacgactttccgcgatgcccatcaaagtctgtttgcaacgcgaatgcggacccgcgatatgttaacggtcgccgaggatatgggaaacggcttgcctaatctcttctcaatggaagtttggggcggcgcaacttttgatgtggcttaccgctttttgaatgaagatccgtgggtgcgcttaaagaagttgcgggctgctttaccgcacaccttgttacaaatgctttttcggggtagcaacgcggtcggatatcaaaattatcccgacaatgttattaaggccttcattaaccaggcagcaaatgacggtgtggatgtctttcggatctttgatagtttgaattggctgccgcagatgactttgagtattgatacggttaagcaggctggcaagattgccgaagcgaccatgtgttataccggggatattttaagtgacgcccatccgaaatatcagttggcatattatgtcgacttagctaagcagttagttgatgccggggcggacatgattgccattaaagatatggcgggactactcaagccacaagctgcgactgaattgatcgcggcacttaaggatgcggtgacagttccgatccatttgcatacgcacgatacaaccggtaatgggattgcaacttatctggctgctaccaatgccggcgtggatattgtggatgtggcgcaaagcagcttttccgggacaaccagtcagccgagtctggaaagcctgtattacgcgttgagtggcaatcaacgtcagccggaagtcgcgatcgaaaaggcgcaattgttgaatcgatattttcaagcgattcgtccgtattatgcggacttcagtaatggtgtgaccggtccgttaaccgatatttacactgtccagatgccaggcggtcaatatagcaatttacaacagcaagcacacagcatgggcattacggattttgaggcagttaaagccatgtatgcgcaagtcaatacgctgtttggcgacattatcaaggtgacgccttcgtcaaaagtcgttggggatatggcattgtttatgttacaaaatcatttgaccccgcaagatgttaaggaacacggagagcaatacgattttcctgcttcagtcgtggcttttttcaagggcgacttagggcagccggtcggtggttttcctaaagccttacaagaaaagattctaaaaggacaaaagccgttaaccgtgcgtcccggacaattagccaagccggttgattttgcggcggtgcgacaggatttaatcgcggcaggtgtgccggatccaagtaccgaagatattttaagtgctgttttgtatcctgatgttttcaaggcttatgcacgcaagcaaaagcaaatcgggccggtgaccaaattggattcaccttcctattttcaaggtatgcgcctaggtgaaacggtggaggtcccaattcgggccggcaagacattgattattcaactaaacgccattggcaaagcggacgccagtggaatgaagacattgtactttaccgttgatgggcagaaacaggaaattcagatccgcgacgctcatcaaaagagtgccggcttgcagcatcagttggccgaaccgaccgataagaatcaaatcggggccccaatggccggaaaaattgtttcggttgccattaagcaaggacagcatgtggccaaaggtgaggctttgtttgtcattgaagcgatgaaaatggaaacaacggtgcacgcaccattttccggaacagtgacccatctgtatgtagaagcaggcgcattaatcaagagtcaggaactgttggctaaactgcaacccggggccgccaagcagtgagtttagaaggtgagaacatgtttgcaatgaaacagcggcaaggtttagtcgtttgggtctattcactcaagcaattaaagaccttgcgccgttatggcaccattatgtacgtttcgcggcggttaaaatacgtttatttatatctggatcgggatgaaattgcagcaacgagtcacaagcttataaaattgcggttcgttaaacgcgttgaaccatcacatcggcctgagttgaaaacagagttcggtgatgaaattggcaaattcaagccgactgaggaagatttggaaaccaaggcgaaaccccaacgacatgccagacttttaaccggcgaggcaaaaggtgatcaacatgcgcgtcattagcggtacatttcggggattacgcttaaatgcggtgccgggtaatcaaacgcggccaaccgccgataaggtaaaggaatcgatgtttaacatgcttggcccttattttgatggtgggcatgcactggatttatatgctggcaccggagcgcttggcatcgaggccgtatcacgggggttaacggatgcagttttggtggatcggcaatatgcagcgatcaagaccattcacaccaatgttgccctgactaaacaggcagagcgctttacggttttgaaaatgtccgtgacgaaagcgattagccattttgcggccaatcaccagcagtttgatcttattttgatggatccgccgtatgcccagcagcatgttctcgcacaattagctgcgtttgtcagcgaacaattagtggtaccaggcgggcgggtgttggttgaaaccggcttggatgttgattatcctgaggtcatccccggatataccaaaatacggcgtcagacctatggcgttgcgcaggtgcttattttagagcgaaacgaggaagaccatgactaagaaaattgcagtatttcccggcagctttgacccgtttacaaatggccatttagacacggtattacgtgccagtcgcttatttgatgaggtggtcgttgcggcgatgacgaacaccagtaaacgtgcgctgttttccagtgatgaaaaactcgcgctgatcgaggccagtaccgctgatatagcgaatgttaaggcagttgcggccccaagacggttgacagttgaatttgcccggtcaattggcgcacggtttatcatccgcggcattcgcaatgttgccgattttggttacgaagctgatattgccacagttaatcatgacttggatcaggaaattgaaactgtctttttgctggcggacaagcagtacgatgccttgtctagtacgattattaaggaggtcgcggcgtttggaggcgacatccatcgattcgtaccggcaccggttgaaaaggccttatatgcgaaactaggtgagtctcatcaagcaaagtaatcatttgaagcccaaaaaacgttggcggtggctagttggcgcgattattgccatcatcttgatcgctgcgtttttattcttccccaccaattattatttggaagtacccggttccgccgaatccttaaaaccgtttgtcaaagtcgccggcaccaaagataaagccaagggaagctacatgctgacgacggtcggtgttgtgggcccggcttcacctgcgttattacttttcagcaaaacccaggcgcatactgagattgtgtccaagcaggatttaatgggtagtgacagcagtgccgaatacgatcagttgcagacttactatatgaaaagtgcggccaataacgcggtagcagctgcgtttaaagccgcaaaacaaccggtcaaaaccgagcatcgcggtatctatgtgatgtccgtattgccacaatcaccatttaaaggcaaactagccctcggagacacgatcacaaaattgaatggcaagtcttatcaaacggcggatgcgtatgtcaaggccatcaagtcaaaaaaagttggcacgaatatcacgttaacctaccaacataagggccaaacgaaacaggcaaccgctaaattaattcgtctaccgcagaccaaacgagcgggtattggcattactttaactgagaatacggcggtgaccagcgatcctaaagtgacgattgatgcgggaaacatcggcggtcctagtgccggcaccatgtttgctttgcagatttatacgcaaatcacccaccaggatttacgtcggggtcgaatcatcgcggggaccggtacgattgatccagatggtcatgtcggtcagattggcgggattgataagaaagttgttgccgcggatgcaaaaggtgccaagattttctttgccccgaatcaaccggccacaaaaaagttgaagcattacgatcctaattatgtcaacaactacgccgaggcggtccagaccgcaaagcaaatcaagaccaaaatgaaaattgtgccagtcaaaacgctcggtgacgtcattcgttatatgaaagcttatgccaaagctgaccagtaagtggttagtggttgtaataagttcaatttaaagaggaactgttgaaaaaatagttctttttgtttgccctgcgtaatgtgttgttgaggtgagaaaaatggcgacactgacttattggctgaaaacatattggtatgcacccttgattattttaatcggcggtttctttttttggcagcaggcgaaggcaggatcggcaaatcagcctttgtcggtgagtgtgaattcccatagcagttcgcacatggcggcgtcacgatctagtagggcaacaagcatgagtggcagtcatcgtccgagccacggtttcgtgcatttaaaaggcgcaatacaacatcccggcatttatccggtcaaagaaaacacgcgctgggatgaagtggttaaagctgccggcgggttgacggcagcggctgatattcaacaagtcaatctagccaagatcgccagtgatcaggaaagcctatatgtcccggaaaaaggcgaaacgtcaactgcaacggcaccacctaccacggcaggcggcacttctgctactgggaagcccgcccagactgccagtggtgccgttgttgatcttaataaagcggatgtggcgcaactgacgaccatcagtgggattggccccaaaaaggctgcggatattattagttatcgcgacagccatggtgggttcaaggatattaacgaactcaaagaagttcatggtattggggataagacttttgaaaccctggcgccgcagctaaccgtgggcccatgagcgggcggttaatcttacttgcgactgctttacttgccggcatcatgggcggtatcggtttgtggtgggtgctggctatcttgcttatttgtcttgtcatgaaaaccaatcgaaccagtttcgtttatgttggcctttttttaatcattggctgggggtgcggaagggcagatgccaatcaatggcagaatccgccgcaaccccgtggtagtgtgaccatcccggcgtcagccattaagcttaaagacgggtatgtcagctttatcggtcgggctgccaacgggattgccgtcagtggtcgtggttcggtctcaaaggaacttgcggaacggttggctagtaatgatcagccggtacaattggccggtggttatgaagtagcacgtttggcacccgcacgtaatcagtttgaatttgattatgcaacttatgcgtggcaaagccggcagcttgcctatgaattagtcaaaccgactttgaacttttcttttcaaccacgaagacaattttttgatgtcgttgatagttggcgcgtccatctgtttgcctatttcgaacaattaccgaacaaggtacgccaatatgccaaagggttgcttttagggcaattggatgatgattttttaacgcaacgccaagcatttgttgatttaggcgtctttcatcttttttcgatttccggattgcatctgttcgccttggttgccgcgctttattggttggcagcaaggttacggataccgcaaggattagtcgatggcctgctattgggattgttgccactattcttattattgctgccattaggtgcgggcttgtggcgggcggtatggatgcggttagctggcattattaatcgttatcttcggtttggcttaaccgggctggatctgtttagtatggtgttgatggtcaacttgctctggcaaccgcgtgtcttgatgaccatgggtgggcaattgacgtacttgatgaccgggttgctcattggtttaccggcgctgcataagtggcaggtgaattggcggttagtattaggcggcatgcctgtcattgcctggcatacgttcagctttaatcttttgacggtattcttcaattggcttctcatgccgatttttgaactgatcattatgccggggttggtatttgccttattgatgccgcacgcagggttaacatatttgtttaacgatgcattgcaattattggagaccatcctcattcgactgagtcacctgcctgggcagattattatcggtgcgtttcccagctggttggctgtgctgggggtttttgttatgatgctggttttgacgtggcaatgttggcccgtagcagttggctggtttgtagtacttgccttgtggagttggtatcagccgaattatcgggtggtgatgtttgacgtgggtcaaggcgatgcgattttgatcgaatccccgtttcatcaaggggttatgttgattgatacgggtggccgcatattcggcaaaaccagccatcctcctgttagccgcgcgattgtcccatatttgcatgcacgcggatatgcccgcttgaatacgctggttttaactcatcctgatatggatcacgttggcgatgcacctaaacttgctgagttgataccgattgagcggctagtaaccaccccaaccgcgcagcatcatcctatgattaaaaaagttagccagcgggttgccgcaacgcaaacagtcacagcggatcaatggctgcaggtcgggccacttcgattacaggtacttgcgccaagtgccacgagccatcacgacccccaggatacaaacgcggattccattgttctctatggtaaaataggtagcagtcgctggttatttactggggatgctgaccaaaccgttgaaaaaacgcaaattctgccgcgacatttgcaagtcgactatttaaaggcaggacaccatggttcaaaaaccgccagtgcaccggcgttaatttcgagtttacagttaaaagccgctttaatttccgctggtgtcgataatcgatatggtcatccgcatccagaaacattggcaacgtttgctaatgcccatgttccatgggtcagtaccagtgaacaagggatgctttgggtggaaccaaacccgcaacgtcaacaggatcagctatttggctggttgcagaaaaggagcaaacaatcgcatgcaggtccgtgattttatcaaacatcttaaaaatggcgaacgaccgccgctgacattaattcttggcgaggagcaggctttacggcaacaggctcaacaagcgctggctaatttgattcctgaagaccaaaaggccatgaattttggccgttatgacatgcatcaaactccagtgggcgttgccttggatgatgcgacttcaattccttttttcggcgaataccgcgaagttgtgattgacgatccttactttttaaccggcgaaaaaagtaccgataagattgaacatgatctcaccggactgcaggcttattttgacaatccggttccgtcaacgatgatggtgttaatcgcaccgtataaaaaacttgatgaacgtaaacggctgacgaaagctttgaagaaggcagctttgattgttgatgctgcgccactggatgaacggtcagcgcgaatggcattggcacaaatcttcaagcaacatcaagtcgatattcagccaccagcactcgatgcgcttgttcagcgaacgaacggacagtattcggtcatgatgggcgaagtccggaagcttctgacgtatgcaagtgatggtagtccattaaccgttgctgcggtatcggcattggtccccaagcagcttaatgatcgggtttttgatctggtaacggatgtgttacgtcaaaatgccgcggatgctttggcactttatcgtgatctgcttgcacaacgcgaagaaccgattcggctcaatgcgttaatgctaggccaatttcgacttttaattcaggttaagttattagcacaaaaaggttacggtcaaggtgatattgctgctacgctcaaggcccatccgtaccgagtcaaattagcgttacggcaggttggtcgcttgccttatcaccaactggcccaggcttatagtgggctggtggatactgaaaccgcgatgaagacgggaacgattgataaggcactggcctttgaactgttcatgctgaagtacacaggtcaagcgtcagcgcatcggaaggggaagtatacggcttcacgctcctaaaactgagatggtcaatgatgtgcgggtgtgcttagccgatgacaacaaaaaataacccttgtggacgaaatatcgtcacacaagggttattaaagttggcataacgccttgattacttgttaagtagggctgcaagacggctcttgtcgcgaccggccttgttcttcttgatcaggcctttgctgttagccatgtcgatggcacgagttgccgctttataaagatcctgactgttgtcagcattttgttcgcttgcactcttgaacttcttaacagcggtacgcattgcgttcagctgggcaatgttacgttcacgggcattttcctgcgtcttaacgcgtttgattgcagatttgatttgtggcatgagatgttcacctccaacagtggattatgataaaactgcataagtttcaacaaacgctattatacagaagccagagcggcaatgcaataaaaagttgtaaaggaaaattgcttgatagctaaaattacttgcaatcagtggcagacttcggtaaagtatgaaggtacttttgaacctgatacttagtttagcgaaccaccgacgctttactcagtttcaggcaatattctgaaaggtggtacaacacaatggcaattgaccaaacgcaaaagaacgaaattatcaagcaatacgcacgacacgatggtgacactggttcaccggaagttcagatcgcagttttaactgctgaaattctggctttgaacgaccatttatccgttcacaagaaggatcatcatagttatgtcggtctgatgaagaagatcggccaccgtcgtaatctgcttgcctatctgcgcaataaagacatcattcgctaccgtgacttaatcaagtcattaggtctgcgtcgttaatcacgtttaacaaaggtcgccgcggcggcctttttgcgtgtttttatattaatagcgggcatcagctagtggtaaaaggccaaaaagacagttccaacttacaggagggatcagctaatgtatccagaatatcggcagcgttatcagggtcagttagtacgcgtcaccattttaagcgtaacgacaacggttgcttgggtgattggcacgattggctcacagtgggcagttgccggtgtgagccgtcatgatgaaaaacaggcgtcctcggaacaagttgatccggtactcgtcgaattggtccgcgttatcgcaggtcgcttagtccacaaaaatttagcgacgacctcattgccggaatcattgctgccaatggtgacggcactgaccgagcatcactggcgggagccggatccggaatcggcgttaaagttgattccaaagccggcaggggcaccgctggacttctggtcatggcgcaaggcggttttcttgacggttccccagcaaaaagttcgaccagctgatttgcatgagtggcttcggaacattttgccgaatgtccatgggttaggatacgggccggtgacagatctggctgccttagctgttttagcgctggataccagtcaccaccttgctgctggcagttcacctgaagtagcggtggtgctggataacggaaaagaagttgctgcgtatcatctggatgccgctcaaacaagcgataccgggtatcaaagtgcacttaaagcggccaaacaaaatctgaaaaccgtgcatcgcttttttgcaaacgaggtgtaactgcgcctccgcgttttaaggtgatatggtagttggaattttaattgtctgatagagcatgttgagctaacgttgtcgtttggatattaagtccacgttctccatccagtgaccattttcgggggcactggatggatttttttatagcattcaacgccaaccatttgccgcctgaaattcggctctataggttttcgccttatcgtgtggtacacttgtatcagaatttattcggcggaggtatgcggcaatcgattgtcggcaaccatacttccataaattaaccacgaggtgaaaccatgacgaagatcaatctggtcgctcttggtggggtacgtgagaatggaaaaaacatgtacgccgtcgaagttgacgaccaaatttttgtatgcgattttgggttgaaataccctgataatgaattacttgggattgatgttgtgatcccggactttagctatttgactgaaaatgccgaccgaattgccggaatctttctaagtcacggccatgcggatgcagtaggagccttaccttattttcttgtggatcatccagttccggtttttggttcggaattgacgattgcaatggccaaggtcttcatgcagcatgacagcaaagccaagaagtttaaagactttcatgttattgatgaaaagtcggtcattgactttggtgatgtgtcggtatcgttctttaaaacaacgcatagcattccaggctcgttaggtatcgatattgaaaccagcgaaggccagattgtgtataccggcgactttaagtttgatcctagcgctaccccgatgtatcaaacggattgggcgcgattggcacaaatcggtaataagaaagtgctggcgttgttatctgattcagccaatgcagagtcgccttatccgaatgccaacgaacatgaaatttatgaccatatcaaagaaacttttgaataccaagatggccgaattatcgtggcaggtgttgccagcaacattcagcgtattcaacaggtgattaatgccgctgcatcgcttgggcggcgggttgtcttgaccggccgtgatgtcgaaaaggtcgttaaaaccgccattcgtatgggttacattaaattgccggatgatgacattttagctaaaaccaaagagctaaaaggcctggcaccggaaaagaccgtcattcttgaaaccggtcggatgggtgagccgatgaagtcattgcaacgaatggcaacatcccgtcatcgcctgattcacatccatgaaggtgatcttgttttcattaccaccacgattgcccatgcgatggaaactatggcggctcgaacgaaagacatgatttatcgtgcaggcggggatgtcaaagtcttaggcgacgatattcactcttccggccacgcttataagaatgatttgcaactgatgatcgatttactcaagccagaatatttggtaccggtacaaggcgaatatcgcttacttgcagcccacgcggaaattgcgcatgaagctggcattccgttagctaacatctttattgtcgggatgggcgatattttgcggtacgaaaaaggccagatgaacgcctccggtcatgtcaacgccggcaataccatgattgatggcattggcgttggcgatatcggcaatattgttttacgtgatcgcaaaatgctggccgaagatggcattttcattgcggttgtcaccattgaccgtaagaaaaagcgcgttgtttccaagcccaaagtcacaagtcgcgggtttgtttatcttaaaaccagtcgtgacttattggccgaaagcggcaccttggtaacggagacggtacaaaagaatctggataacaaagaatttgactggacccatttgaaacaagatgttcgagataaactcagccgcttcttattcgaacagacaaagcggcgtcctgtcattttgccggtcatcatggaaattaatcaaaacagtgcaaaacggcaataaacaacaaaaaattcggatcattttccgaatttttttattgtcattgcaatatctgaataaaacaacgacaggaggaaggcatgaccaatatggtatcattacccgacaatgagcaacgtcacctgacaatcggcaaacaggcgctgcaaaagggtaactatgcttcggcggcggcgcatttagaaaaggcgtatgaagcaaagcaaacttttgcaatcgcccagccattagcggctagtttaaatgggcttaaacagtttcatgaaagtctcaatgtgatgttggcgcattaccagtcgtttatgcaaacagacggtgatgtccaactggttttggatgcttggcttggtacgcttaactttgtcatggcgcgaacgatgctgcggcaacttgatccgattcggcgccagcgttttcgccagcaaattgaggcggcagaagctttagccttgaatgaacggagcgaacaaattgcggaactggttcgcaaagtcagccatctggggggcttttcccggcaggagcagcaggatctgtttagtcaggtggggttattgccaaaagcacaactcatcaaagcggcggttcccgacttgatcgacgaatcgattccagtggcgatgcgcctgtcattgttagaccttttaacgaatgttggctatgatcaaccggtgcaatatcaggcttatgatcgagtcgaaaccattattccgagtgagttacccggcatggcggatgagccaaccgggccacagattctggatcgactgcaaaaagcattaggcgatgacgatcaggagctggggcaagctttgatccaaatggcgcgggtacagattgcctttttatatccggatatcagtcggctaattcctgaccaagcggcatttgttcaagcttatcttgatcatcatcaggggaaaaccaccgcgtttgacgatctttttgcttggcaagcggctgaaacagcgaaattgtccgaataggcgtgatgacacgttttcactgtaaatgaaagaaacttgacggtagctgtttacaaagtgaaaatgaccatgtatactcattgctggaattcatttccagcgtagatatttgttttggtatttacgctcaaatgtagtacacttaaacgtaaaggattatcagggtacacaaacaaggtatcctgtattcttacgaaaaatacaggaggttcgttttttcatggctgaaaaagaacactatgaacgcacaaagccccacgtaaacattggtacgatcgggcacgttgaccacggtaaaactactttgaccgcggctatcaccaaggtattgtcggagaaaggccttgcccaagcgcaggactatgcttcgattgatgctgctccagaagaaaaagaacgtggtatcaccatcaacaccgcccacgttgaatatgaaacggaaaagcgccactacgcacatatcgatgcgccagggcatgccgactacgttaagaacatgatcaccggtgctgcccagatggacggtgcgattctggtcgttgctgcaactgatggcccaatgccacaaacacgtgaacatattctgttggcgcgtcaggttggtgttgattacatcgttgttttcttgaacaagactgatttggttgatgatccagaattgatcgacttggttgaaatggaagttcgggaattgctcagcgaatacgattatcctggtgatgatattcctgttctccgcggttctgccttgaaagcacttgaaggcgatcctgaacaggaaaaggttatcatggaattgatggataccatcgatgaatatatcccaaccccagttcgtgaaaccgacaagcctttcttgatgcctgttgaagatgtcttcaccattactggtcgtggtaccgttgcttcaggtcgtatcgatcgtggtacggttaaggtcggcgatgaagttgaaatcatcggtttgaagccagatgttctcaagtccaccgttaccggtcttgaaatgttccgtaagaccttggatcttggtgaagccggcgataacgttggtgtcctgcttcgtgggatcaaccgtgaccaagttgaacgtggccaagttttggcaaagccaggttcaatccaattgcacaacaagttcaagggtgaagtttatatcttgacaaaagaagaaggtggccgtcatacgccattcttctccaactatcgtccgcagttctacttccacaccaccgatgttaccggtgtgattgaattgccagatggcgttgaaatggttatgcctggcgataacgttactttcgaagttgacctgatcgctccggttgctatcgaaaaaggtaccaagttcaccgttcgtgaaggtggccgtactgttggtgccggcgttgtttccgaaattcttgactaatttctgaataaacgtttaaaagtctgcaagcttgcttgcaggctttttttgtgagcgcgagccggcgcggttagaagccggagtgtaagcggccttagccgtgatggctggtctttggccattgcggctaaggtccttacacgcagacttctgcgccggggaacacgttatgggagtaagctggaacatatgaggcataatggccgggctttggccattgcgcctcagggtctttacacgcagacttctgcgctggggaacgcgttatagaaagtgagcgcgagccggtgatgattacagggttgcgtgtcaggtcaataataatggataaggaatgaataatcgcaggtattttacgtttcaagattttgacgcttgaacagccttgggaaatcaaagattattttatcgaatcatgacaccaaaaaatctcaagtcgtgtttggcttgagattttttgggctattttcagcagggattaggtaaaccaagtaactgcaaaacattagccgctctgagtgatcaaggaagggatttaaaattaagctgactgtttaatttcgcttggctgtgtcactgtaatcttggttttagctggttcaattttgtccgcttccagaatgatgttaccgatcgattgtactcggatgttgccgctgcttggattcttgacgctgacaatatcggaacaaatatcggcattgatattggtgctgtattcaaagaccaaatcggaatgaagcagtgcgcagtttttcattgttaaatgatcaacataacataacccctgattgctctcgattgtacaattgataagcgtcagattttttgtattccagcctagataagcaccattaatagtggaatcatagatagtaatgttctcacagttccaaaatgcatctttggttacaagcgtggaatgatgaatttcaacatttttagcaccatcaaaggcgtaatcaccaatcaaatcgaggtggtcggcgacaatgtttgtgctattcataccaaaatagttcccatttgcttgcacatggtcgagtctaatgtgattgcagttccacaaactttcactggcatcggaaaaaatgaacgttttttaggcgaatattctggctacggcgaaaagtttttggtgcttgaattgtactatcggacatagtgatgtcattcgtataccagatgcctgaccgcgccatggtttcgaagatggtgttagacatcgtgatgtgctggctgtaccaaagtggatacttatattgaaaaattgactgatctagtttaatattgcgactttccttcagaggagattcaccttttccaaaagtcgttttgacaatggtggcattttcctgaccaaacagagaacgttcaccatgaaaaaattgattgttgtaactcaccataaaagattcgcttctttctatatgttctcgaaaaatggtcgctacttccaaaactttgattgcagctgttacgctacgatgtcatggagaagttcagcagccttaccagataaataaatggtatttgactcatgcaaactgtctctagcagattgagaggtattgatgacaatttttggacagtttaatcgaaaactggtggcaggacggcgcgtgccaatgattaacaagaggtccgcttgtgcgagcatttgctgaccatattttatttcgtctgggtaggttgccaggtgtcttaaaacgaagtcaggtaaaatcagtccgccacaattggggcaagtcggcacagtgctggttgacggtttttgccagtcataagaatgatgacaaatcgtgcagtgattatgccggacatcgtcccagtattcggcaacatgacgggttccggctgtttgatggagatagtcaacattcatcgtcaccacaccaagcagcttgttagcctgttcgagctgcactaacgcttgatgggctctgttgggtaacgcttccggctgacagaacgtctggcggtatagctggtagaaagcggacgggtcggcgctgacttcttctggatcaagaaaacgaaatacgtcaccagcaaatttgtgtgatttttttaagatttgatcaatcccgttcaaatctggaatgccagattctgtggagataccggcaccagtgaaggcaacgatttggtgatgttggcgaataagggttgctgcctgctgtaaacgttgtgcttgtttcaagggactcatctggtttcgaaaacgtgccgggcaaccgttaagccatttagtacccgaggaaagccaatataaggaatgcagtgaatcatcgtttcgacaacttcggttttagtcagaccgacattgagtgcaccattgagatgaacctgtagttggtcggcggtatcgccttggataagcagcgcggtcacggtgatcatttcccgctgttttagatccaagccgggacggttgtaaatatcgctaaaagcaaattccaaaatatatttaccaacatcaggcgcaatgtcggctaacgaatgcataacgttggccgcagcctcaccgtcaacttgggcaagcgtctcctgaccattttctaatcgtgttttttctgacatgttcatgacctctttcatttaggatagcttcactctaaatgctggagttaactccatgtcaatcacttttttgaattttctgtggttaatttggcttttagctgatgataggtcgtgattttgttttctaaaaatgcaatatgggcatcaatttcccggcgttgtgccgctaaccgggatttttgcgtgaagagtaacttcagacgttcgtcaatggtgctattgccttgataacgtaaacgggcataagttttgatttccttgatgggcatgccagttgcttttagccgcttgatgaatgcaatccagcgctgatcagcatctgagtaggtccgtcgattattttgatcgcggtcgggaataatcaagtgttctttttcgtagtatcgcaacgtatcaattgacagtgaaaccaattttgaaaatttaccaattgggtagcccatcaacgaagccttctttcttaggttatgttgggttgtatgatgagactttctgtgaaattagtcaatacttatacaagaggctaagcgttttaatcgctaaactaaaactattgttatatgataaagtctcggaaaagggggccattcatttgacgaaatcaacaacttggcggatgatcgcatttttctggcatcagctggcagatatgaaacgtcaattgttccgtattattgcggcattggtaggggtggcggtggcttcgtatctggtgccgcgattaacgcaatatgtcattgatcaggtcattccgcaacgtgcgatgggaacactaatgggcgtgattgcgatggcgctcttgctgacggctatggctgggtggttaagcggtcttagtacttattggatcggtcaggtgagtttgcatgcaattgcccgcatgcgcgatgacttgtttcgccatacgctgggattagatatgcggtattttgaaacgagtcaaacgggtgatttgatggtggtgctcacgagtgacgtcaatacgttacagcgtttaatatcgagcaatacattgggtctatttggcagcttactcagttttgtcgtcgtactggtgctgatgatcgttcaggactggcaactgaccgggctgattttattaacttttccggttttgtttattctgaataatattttcgttcgcaacattcgtgctgcttatcggcgggtgcgggcaagctctggcatgatgaataatcaaattcaacaggctttgacgagtatcgggctgattaaaagctttacgaccgaagccacaacggcaaggacctttcaacaagccaatgcacgtaaccgcgattatcaacttaaagcgaccaaactcagcgcgactttttcaccgctaaccgatttcgtcaattatttgggaacggcaattattttaggctttggtgcgattcaggtgatgcatggtcagtttacgattggcttgatcgtcgcttatactgcctatcttggcattttgcaggcgcccattcgccaactgaccgggttgattcaacaattacagcaggcaacggtttcgtttgaacggattgaagcattgcaggcagcgactccgcaaattgtttcgccgccaaatgctgtccacttgccgcgatttcagaaacgaatccagtttgatcacgtagatttcagttacgatgaggctgtgccagtactgcaggatgtcgactttaccatcgaaaaagaagaagtcgtggcactggttgggtcgtcaggcgccggaaaaacaacgattacaaatttattggcgcggttttacgatcccactagtgggcgtattttgatggatggcatcgatttgcgtcaggcggatctgatgagtttacggcaacaaattgccattgtctcgcaagatgtgatcttgcttgatggcaccattcagcagaaccttgaatatggcacatcatctgccagtgaggcggccatttggcaagcagcagaggccgctaacattgcagcttttatccgcagtttgcctcaaggactggcgacgcaggtaggtgagcgcggaattcggttatcaggcgggcaaaagcagcgcatcgcaatcgcgcgagttttcttgaaaaatgcgccgatcgtcatccttgatgaagcaaccgccgcattggataatgagtcggagcgttttgtgcaaaccagttttgatcggctaatgactgaccggacatcgatcgttatcgcgcaccggctttccaccgtgcggcacgcggataagattcttgtattagcacatgggcgaattgttgaagcggggaatcacgagcagttaatggcccaaaacggacgctacaaggaactctatgatttacagtttacgtgattgctgttgttgcgattgttattcttaggttcatgcgcagtttgtgaaaatcagaaaaaatcaagttgcgacaaggctttttttgtcacaacgtttactttcccaccggtttcgggtatcatacattaagtatgcaatgtgaattgcgagactaattgtcggaggtacagcatgtctgcaaaatgggaaaaaaagggcaccaatgatggtgaactcacctttgaaatcgatttaccaaaaattcaagaaggcttagaccaggcgtttcaacgtgttcgtaagaacctgaccgtccctggatttcggaagggcaaagttagccggaccgttttcaaacggatgtatggtgatgccgcgttatatgaagacgccttgaacatcttgttaccagatgcttatgaagcagcggttaaggaatccggtattgacccggttgaccaaccaaaaattgacgttgagtccatggacgaaggcaagccttgggtgatcaaggctaacgtaacggttaagccagaagttaaacttggccaatacaagggcgttgaagtgcctaagcaagacgttgaagtatctgacgacgacgttaacgctgaattggaaaagcgccgcgaacaacaagccgaactcgtggttaaagacgacaaggcagctgaaaatggtgataccgttgtgattgattacgtcggcaccattgatggcaaagaatttgacggcggttcttccaagaactatagtttggaactcggctcaaattcatttatccctggctttgaagaacaattggtcggccataaatctggcgatgaagtaaccgtcaatgttacgttcccagaagactacaaggcaaccgatcttgctggtaaagcagctgaattcaaaaccaccattcatgaagttaaggtcaaggaattgccagaattagacgatgactttgccaaggatcttgatgatgatgtcgatacattggctgagttaaaagacaagatcaagaaagaattgaccgatcagcgtaaagaagcggccaagaatgcggttcaggaagcggccatcaagaaggctaccgagaacgcaacgatcgaagaagtgccaaatgcgatgattgaacaagaagtgcataatcaaatggatcaatacctaggcaatatgcaacgccaaggtatcagtcctaagatgtactatcaattgaccggtacgactgaagaagatctgcataaacagtttgaagccgatgcagaaactcgggttcgtactaacttggttcttgaagccatcgttaaggcagaagatattcagccaactgaagatcaagtgaccgaagaagttaagaatttagcttccgaatacaacatggatgaaaaagccgttcgtcaggcattgagtgaagatatgctcaagcacgatattggggttaaagaagccatcgacatcattactgacaatgccaaagaggttgaagcggccaaggatgaaacagctgataaggctgattctgacaagaagtcagctaaatagttgtcacaatcgcgtcaaagagacgatccttgatcgtctcttttgtcgtcttaacaggtccaaaaagccgaacagatcccttgacattggcatagcggttagttgctagtcggtacttgacggttctggtagaatgaaggtaacaagaaagggttgaattagatgtttgacaacgttgaaacaacgggtccggtgacttgctctttttgtggcaagtctcaggatcaagtgaagaaaatcgttgctggccctggggtttatatttgtaatgaatgtatcgacctctgcaaagagatcattgacgaagaatttaaagaagaagcctatcagaatctgctcgaagtccctaagccaatcgaaatcatgaaatcacttaatgattacgtgattgggcaggatgctgcgaaaaaagcactttcggttgccgtttataatcactacaagcgcgttaaccagatgcagactgcgacaaaagacgatactgaactccaaaagagtaacatcgcactgatcggcccaaccggttcagggaaaacattcttggcgcagactttagccaagatcctgaatgtgccatttgccattgcggacgcgacaacgttaacagaagctggttatgtgggcgaagacgtcgagaacattttgcttaaattgctgcaaaatgctgattacgatgttgagcgcgctgaaaagggtatcgtttacattgacgaaattgacaagatcgccaagaaagccgagaacgtttcgattacccgtgatgtttccggtgaaggcgttcagcaagctttgttgaagatcttggaaggtacgattgccaatgttccgccacagggtggacgtaaacatccgcaacaggagtttatccaaatcgataccaccaatattctctttattgtcggcggtgcctttgacggtattgaaaatattgtcaagaaccggattggcgaaaagacgattggctttggtaccgactccaccaatcaagtggatccggataagtcactgatgcagcagattattccggaagacctcatgcaatttggaattattcctgagttcatcggccgaattccgattttggcagcattggagaagctcaacgaaagcgacttggttcggattttaaccgaaccgaagaatgcgttggttaagcagtatcagaagttgttaagtctcgatgatacggatcttgaattcacacctaacgcattgaaggccattgcccatcaagcgattgtacgtgacactggggcgcgtggcttgcgctctatcatggaagccatcatgcaagacaccatgtttgacttacctagtcgcagcgatgtcgacaaggtagtcgtcacaaagtctgctgttgaaggcaaggctaaaccacaattagtgcttaccaagggccgtgaagcctcctaaagcaagcagggtttcaaagagcaccaggttggataacctggtgctctttgtttgggctcaaccatgaataaagatttgtaaattcctgctagcggcccagtcagcttttaaaatatgctaaactattgaaggcagtggtgcttgagtgccactaaaagagatgaataaaaaaggaggccgtttaagatggacgtccatgatgtcaaactgacaatcagtgcggttgcggctgcgcaatatccagaagatggccgtccggagatcgcctttctcggacgcagtaatgttggcaaatcttcactgatcaataagttaattaagcgtaaggcgatggctagaacatccagcgttccggggaaaacccagacgcttaatttttacgatcttgatagtcgcctgttttttgttgacgttcccggttatgggtatgccaaggtcagcaaatcagctcgggcaaagtttgcagcgatgatcgagacctatcttacgacgcgacaaccattacgtggggttgtcttgctggtggatagtcgtcatgagccaaccgccgacgatatcagtatgtatcaatatttaaagtattatcagctcaggactttagtggtcgccacgaaaatcgacaaaacgcctaaaagtaaacggctgcatgttgttaagcaaattaatcaacggttggatttaaaccagactgacacggttattccgttttccgcagtcaccggtgaaggctatgatgcgatttggtcttggttgagtcagacttcgggagtgggggaaaatgaataatgaactttaatgaatatcaacagaaggctaaccgcacattggctggcaacgaacatgtgttaaccaacttatcgctaggcttggcaagtgaaagcggcgaagcaattgacttgattaaaaagtacacctttcagggtcaggatttagataaggttaaattacagcacgaattaggggatgtgctgtggtatctttctcaaattgcattgtgggctgacattgactttgatgatgttgccgctggtaatattaaggcattggcaaaacgctatccgcaatccaaaaagtgaacttagcaccattcagaacatatttaaacgcagctaatgatttagcgtctaaaaaagcgacctccgaaaaattttcggcagtcgcttttctgtttgcttgagtatggaaatcagcataaatggttactttactttttcggctttttagcgctatctttatcagactttttcgtcatcttttcgtgatgttttggatctggcccggtagcttgttctttatcgctgggaatgcttgcgaatttatcgaacatgtcgtttaggttggtttgagtgttgatcttaagtgccatgcacggccacccctttccttggagaaagtatagcatcaaccagcattagcgtctagactgacaaccggtttttctaatgccgatatttggccaaaggttgatcttgaaaacgatttaagaactaggccgtgtttttcgatgattttacgagttaaaaaaagagtcaccaaaatatgaatatttattgcataaaaattgaattacgtgtatagtacattcttgtaatcaaggagggtattatgacgcatttgaaacgttggttaatcgctttggtcgcagtttttgccgcaattgtgaccttaaatatgcaaactgtccaggcagatgacagcctggcaaagattcaacaaaaaggcacgattgtgatgggcactagccctgattatgcaccatacgagtttttggtgaataaaaatggcaagaatcaggttgtcggcatggatgtcgaagttgcccgcaaaattgccaaggatcttggggtcaagttagtcatcaagcagatgaatttcagctcgttgctagtggcgctgcaatccggcaaggttgatatggtgctggctgccatgtcaccgactaatgctcgccgcaagtcaattgatttctccaagacgtattataaatcgggtcaggatattctgattaataagacggatgctaagatttacaaagaccacaagagttttgccaataagaaagtcggcgttcaaaacggtagtctgcaggagaccttagcaaaaacccaaatgaagtccagtacgactttaggactgacaaaagtaaccgatttgattctggcgctaaaaacccacaaagtcgccggggttgtcgcggaaggtgcggttgctgaggcctatacgtctaacgatgataaattggttgaaattcccggtcattttaatctgtcaagtgacacgatggggactgctatcgggtttgccaaaggatctgattctttagtcgcagcggccaataagagcttagcagatattaaacaaaagaatttaatcccgcaatatctgaaaaccgctggcagttacatgaagacgaataccgaagataccagtatgctgcactattggacttatttccttaaaggggttgagtatactttactcatcagtgcgattggggcgttctttggggtcttacttggtacgatctttgctttattgcggttgagtaagcatcgattgccacatctcattggggttgcctacatcgagttcgtccgtggtacgccgttgatgattcaggtcatgtttgtctacttcggtattggcattttcattgatattccagcgctagtagcagggttgatcgcggtatcgcttaattcagctgcatacgttgccgagattatccgtagtgggattgatagcatcccgattggtcagactgaagcggcccgttcgctgggcttatccgagcgccaaacgatgaccagcgttgtgttaccgcaagccatcaagaacatttggccagcgttaggaaacgagtttatctcactgattaaggaaagttccattgtttcgatcattggggttacggacttgatctatcaattaacggtggttcaaaccgcaacttataaaggtgttcagccgattctgatcgcaatggtcttatattttgttttgacattcgggctatccaagctcctgagtcactttgaaaggaagatgaatcatgcagcataaacctttgatccaaatcaaccacttgaccaagaagtttggcgataatgtggtcttgaatgatattagcgaaacgattgaccaaggcgatgtgattgtcgtgatcggtgcgtcaggtggcgggaaaagtaccttcctgcgcagtttaaatctgttgaaccgtccaactgcaggcgaaatcctttttgaaggaacaaacctggttgatcttagcgaaaagcagttggataatgtccgggagaaaatggggatggtgttccagagcttcaatctttttccgaatatgacggttctagaaaacatcaagctggcgccgttaaaagtcaaaacggtgacggatgaagaagcaaccaaaacagccaaggaactgttggaacaagttggcttggcggaaaaagccgatgcctatcctgctagcctctccggtggtcaacaacagcgggtggcgattgcccgcgcgctggcgatgcaccctgatgtgatgctctttgacgaaccaacgagtgcattggatccggaaatggttggtgaagttttgaaggtcatgcaggatcttgccaaaaccggaatgacgatggtcgtggtgacgcacgaaatgggatttgcccgcagtgtggccgaccaagtctggtttatggatggcgggaagattcttgaaaaaggcacgcctgaacagcttttcgaacatcctcaagaagagcggacacaagactttctttctaagattctcgcacaataattttcatcaaagtactttgtctggcacatactgggcaaggtgctttttttgtgaaatcgagctggtggggtatcatgaggtttgaggcagaagtacaggctagatgtgacaagcatgctggcatgtgtataggctatctgcttgcaatcgtattttagaatctttataatgttaggcgaacatttgttttataaggagcttacaatggcatctgcacacattgaacataagttatcgttactgccggatcttcctggtagctaccaaatgaaagacatcaacgggaagattatttatgtcggcaaagccaaaaatctcaagaatcgggttcgatcctactttaagagttcgcatgacggaaaagtagcggcaatggtggcacaagtggcggattttgactacattgtgacctctacgaataaagaggcgttcttgcttgagattacgttgattcaaaagtaccaaccttattacaatatcaagctgaaaaaggggactggttacccttatatcaagatcaccaatgaacgcgaccccaagattgaaattaccgggacgattcgcaaagacggcggctactattttggcccttatcccaatgtttacgctgcccaggaaaccatgcactttattcaaaaagtgtatccactacgccgctgtaacggctatcagggtcgcccgtgtctttattaccatatggggcagtgtctcggcgcttgttttcgcaccgtcccggagaaggaatataccgatcagattgcgcgaattaaacgctttttgaacggtaatgtcagcaaggccaaggccagtttgactgccaaaatggagcgcgcggcaaagaatctgcaatttgaacgggcagccgagattcgggatcaactttattacattgagcaaacggttgagaagcaaaagattatttcgacggataataccacgcgcgacttgtttaatttttatatggataaaggctggatcagcattcaggtcttctttattcgccaggcgcgattgatgaagcgtgagtcgcgcttgtttccggtggtcaatacggctaaagaagagtttgaatcttttatcttacaattctacagccggaaaaataacgttaaaccgcgtgaagtattggtgcctgcagggctcgataataaggtgctagccgatatccttgaagtaccggtgcgcacaccccaacgaggcgaaaaacgcgagctgatggcgctagcagccaagaacagcaagattaaactggaagataagtttcggttaatggaattagataatcgaacaacggtaggggcgatgaaagagctgatggcagccttaaagttaccgatgggccatgtagtagaagcatttgaccatagtcatatccaaggtgccgatccggtgtctgccatggttcaatttgtcgatggccaacctgctaaaaacaattatcgcaaatacaagttggatgcggacaaaacccataatggtgctgacgaagctgccaatacgcgcgaagtcattcgccggcgatatacgcggctgctaaaggaacatgcggcattgccggacttgattctgatggacggcggtgagattgaaatgaacgcggctaaagatgtcctggaaaatgaattgaatctcgatattccggttgccggaatggtcaagaacaataagcataagacggctgccttgctattcggtcacgccgacgagatgatcaatctggatccgaagtcgcagggcttctacctgttggaacggattcaggatgaagtgcaccggtttgccatcacgttccatcgccagcttcacgccaaaaactcgttggcatcgcgccttgagggaattaagggcgtcggacccaagacacgcttaaagttgctgcgtaaattcaagaccatcacaaagatcaaagaagcaccattggaagatattcaggagctaggcatttcaaaacgcgtcgcccaggcactgaagctttcgttaacggcagatcccacgccggcacgtcgggtataaatgatgcggataacgtggtaattttttagagccgttttcaagacaatggaaaaagcaggttccaaaagacaaacgttgccttttgatgcctgcttttttacaagattattgagaaccgaaaaccgaatttaaaaagcgtcattcaaacgcacaaaaaaactcgcagcgcattttcaaagctgcgagtttttaatttaagccatgaccactatcaagtgacgcttacaagcttatcttgacttagcgattctctttagcaactggacgccagaagccaagaatcagtgcggcgatgatggtcccgataatcaatgacatgataaagccaaatttctgatcggttagtaagagtgcaacgacaccgccatgaggagccggaacattaacgtgccagagctgagttaaaccaccggcaatcgcagaaccgattacggagctaccgatgatgtgcaatggatcggtggctgcaaacggaatcgcaccttcagtaatgaacgttaaaccaagcgcatagttagataagccggcattgcgttcctgtagggtgaatttcttcgggaagaaagtggaagcaaccgcgatagccaatggtggaatcataccgccgatcataacggcagccatccagcgaccatctttaaagccagatgcttgataaacgccaattgcaaacgtataggccgctttgttgaaaggaccacccatatcgatactcatcatggcggctaggatgacgccaatgagaatggcattgccagtacctaaaccttcaaggaagttaatgagtgcaccgttgatcgctgcaaaaatcgggttgataatgaagaacattaacagccccataatcgcaagaccgatgaccggataaaggagaatggtccgcataccgtctaatgagcgcggcatcttagccaatgcttttttaagacccacgatcatccagccggcagcaaacccggcaaccagaccgccaaggaagccggccgggttttgcgctttcacaaccgatgccgaggcaacggttgccatataaccaccgacaaacccaggcatcaaggcagggcgatcaccgatagattcggcaatataagcagctaataccgggaccaagaaactaaaagcaaaagaacccagattattcgtgaacgtgaaccacatagaggtcttacccagccattgttccaggatgaatgagatcgccatgataatcccgccgccaacaacgaatggtaacatgttggagacaccattcatgaggtctttataaatgcgattccagagggtgccgccggaagtctcttcactttcactggtttcggtgttggcttcaccagcagcgtgaaagacttggccttgacctttaagggtttcttcgatcagttcttgcggtttcttaatgccatcaatgacagggcgattcagcaatttcttgccattaaaccgatccatcgcaacttttttgtctgcggcaacgatgacaccggccgcacggttgatgtcagcatcggttagcttgtgcttgatgccttcagagccgttggtttcgactttaatatcaacgcccattttctcggcagtttcttttaaagctgcttcggccatgtacgtatgggcgattccagttgggcaggcagtaacggcaacgataaatggccgttctttgcgcttttcgtctttaaactcagcttgcttagcggctttgtccttggcttcttgggctttttccgcttcttcttcagctttgtccttggctgctttttccgcttgtgcttttccaaaaagatcgatgacttcatcaggggttttagcctgctttaagtcagcgaccagttttggattgatcaaaagtgaagacaaggcagctagagcagctaagtgttcgttattggcgccttcgggagcggcaatcatgaagaacaagtgcacgggctggccgtctaatgcgttaaagtcaacgcctttggtacttttggcaaacagaaccgttgcccgggtaaccgcgctgtctttggcatgcggcatcgcaatgccttcaccgattccggtagttgattctgattcacgctttaaaatgtcattgcgatattcgtcagcgtcagtcacaatgccttccgcgtggtatttagcaaccatttcatcaatcacggcctctttggtggtgcctttgaggtccatgatcatgacattttttagtagtaagtcacgaatgtccattttgtcctcctaaacttctttaatgttaatcgtctgcttgacggcagcgatcttatcggcagtggcaagatcctcagaaaaagcagttgcagaaccgcatgcgattccaaccttaaagctttccagaacatcatgtgtttgcgcaaaagttccggtgaaacccgctaacatactgtcgcctgcaccgaccgagttcacagcaggttgctttggtacgttaccgaaccaggcatgatcctgctcaatcatgagggcaccaccgcctgccatcgagatcaaaacatgttgtgcgcctaaatcaagtaagcggcgaccggctttgataattgcctcatgactggtatatggtgcgtcattgaacagagcagctaattcatggtgatttggtttcacaacaaggggatgatcgggaagggtatccagtagtgcctgaccggtggtgtcaatcacgaagtctgcgtcatgcgcatgaattaaggggataaggtcccgataaaatgtgcttggtaatcctttaggcaaacttccggacataataacgacatcacctgattttaggttggccagcttagctttaaagtcggcaatttcggtctcgctgatagcagggccgctggcgttgagttcggtttccgattctgctttgagcttgacgttaatccgggtatcacctttgacttttgtaaaatcgcaaggcatggcaagcgcgtctaacttatcttgaataaacgtcccggtgaatccgccaaggaatccccaggcagttgtgggcaagccgagtgtttgtaatatacgactcacattgatgccttttccacctggcaatttaacgtcgtgggccaaacgattgacagcgccaaggttaagccgaggcaactcaatgacataatcaatcgaagggttgagcgtaactgagtagatcaagaatgaacctccttaatattttgatacctttgatagctcgctggaagcccttgtagtgaactggtcaggatggttgcatcgccaatatcggcgaatttgacgaaactgacctgttcgaacttacttggatctgcgagaatgatcggttgacgcgcttggtgaatggccaagcgcttgatcacggcttcttccggatcgggtgtggtgttcccaaattcagggtgaataccatttgtaccgataaaggcgatatcgaaacgataatgatgaagtgcttccgcagtcgttgcgccaatcagcgccttggttgctgacttgaccataccgccaagcattaaggtcggaatttgataatcagctaacaatgaggcattatcaaccccggtcgtaataaccgtgaccccaagatcggccaaaaaaggaatcaactgggcagtggtcgtcccggcatccaaaaagaccagatcgtcttgttcaacttggcgagcagcggcatgagcaatggtttgttttgcccgtaagttttgcgttgacttacttgccacgtccggttcatcgccaagaccgttgacacgtttggccccgccatggatccgtttaagttcgccggctgcttcaagttcatccagatcgcgacgaatggttgattccgatgcatccaacgcggccattaacgctttagatttaatgacggtatgttgttgcaattgagcaaggatgtattgtcgccgttcttctgtaagcactttcgtttcacctcgtccttcattatactgatgaaacgttcaaaatcaacctaaaaccgttaaaaacattcactgctgtcacaattcgaaccttttcattttgctttacatttttacgatattgttgcgcttgaagtgtgagtccttgtcttggacgtgttaaaatgaaaaaggcatctgatttactatgcgaacagcgcgataacgcgtataattaaaaattatgttttttcagaaaggggatcgccaatgtttgtcgatcaggtacaagtagaagttcaggcgggcaaaggcggtgatggcatggtcgcgtttcggcgcgagaagttcgtgccgtttggcggaccagccggtggtgacggcggccgcggtggcagcattattttatatgttgatgaaggcttacgaaccttaatggattttcgctatcaacggcactttaaagcgccagccgggggtaacggccaaggcaagtcgatgtatggtcgcgccgccgaagatcgccgaattgccgtaccagctgggacaacggtcacggacgctgatactggtgaagtcctcggcgatcttactgcaccggggcaagagttggtcgtggcaaaaggcggtcggggtggacgcggcaacattcactttgtctcgcctaaaaataccgctccggaaattgcggaaaacggtgaacccggccagcatcggtttattaagctggaattgaaagtgctggctgacgtcggtttggttggctttccgtctgtcggtaagtccaccttgttgtcggtggtaacccaagctaagcctaaaattgctgcctatcagtttacaacgctcgttcccaatttgggaatggtgcagttggatgatggcaccgattttgtaatggctgatttgccgggtttgattgagggcgcttcacagggtgttggcttaggcatccaatttttgcgccatgttgaacggactcgggtcttgttgcacctagttgagatggatccggaaaatggccgtgagccgctggaagattatgatcaaatccgtaaagaattaggcgcttatgacgaaaatatcttaaagcgtcctgaactgattgttgccaccaagatggatttgcggggtgcagcggaacggtttgccagctttaaggcagctttagttgatcgcggcattgatccggctaatatttttgaaatttcaagcctgacccaccgcggcgtcatgcctttgatgcataaaaccgcaacagtcttgaagacggcgccgcaattcgagccaaaacaggaaccggttcaatcgaccgagtacaagtacacgccggaaccagcattgaaagtgacgcgtgatagtgacggtacctttgttctaaccggcgagaaggtggagcgggcatttaaaatggccaatcttgatcatgaagacggcgtcatgcggtttgcacgccaattacggagcatgggcgttgacgatgccttgcgtgaggccggtgcacaaagcggcgatttagtcgctattgatgattttacttttgagtttgttgaataatcttcgagcagcatgttgtaaagaattaattttataaagaatggtggggcctcaagtgaaacagacgcgcaaacgaaagcgtcggtatatccatggattcgacgggttacggacaattggtgttattggtgttattttatatcatttacgtcctgaactttttaggggcggatatctgggcgtcccaattttcatggtagtttccggttatttaattacggatggcctcctgatagaatttgaccgctatcggcacattgactttaaaagtttttttattcgccgatttaagcgactttatccggcgcttaccaccgtgttgtttggtacggcggcctatattacgcttttctcgcagaatctattgcataacctgcatatgatggttctgacaaacctgttatacgtttataactggtggcagattttaaatggacaatcctatttcgcccgctatgcgaatggagaatcgccgtttacgcacttgtggacgctctcaatagaaggtcagtattatcttatttggccgtttttggttctgggcttactattgttggttaaaaatcggcatcagattgccaatattgtcctgattctggcagctgttagcggcgcgtggatggcgatcttgtacatgatgacggttgcccacacatcgccagcggcttttgacccaagtcggctttactacgggacggatacccgtgcgttttccattctattcggtgcggcacttgcctttatttggccgagcagtcggttatcgacgcatttaccccgcaaatgggtttttagcctcgatctaatcggaacggtgagccttgttgggttactgacgatggttttcacggtcgatgcccagagtagttttctttatgaagggggcatggtccttttctccattttgacaacgattttggttgcagtggttgcgcatccggccgcacattttgatcgcttgttgacgaacccgctgtttagttatatcggcagtcgcagttatggtctttatctctatcaatttccggtcatgatcttctgggagaatcgtttccgcaacattgccgatcatccggttttatatcctgtgattgaagtgattttgattgttctgattacagagatttcttatcggttgattgagcagccggccgcgcattttgattatcataaaacctgggactttcttaaggcactggttgaccccaaaaaacgaatgggtatggcccgttggatcagttatgccgctgttattattttggcaattgggagcgttggccttgctaaggcaccttcagccaaggcggtcggtgataattcacctctggcaaagcagttgaagcgacacagtgagtcggctaaagaaaaggctaaacgtctggaagcaatgcgctccagtctgtcagagcagaaaaaagcggataaaaataaggccaatgagtcgtcaagttcgcgcgcgcaacaatccagatacgcttcgcaggccaaaacaaagccggtgaatcaggactatgaacgttatgggctaacccaaattcaacttcagcaagctcaggatgttaccttcacggcagtcggtgactcagttatgcttgacggtgagccgggacttcaacagcttttcccaaaagcggtgattgatgccgcggtttcccgacaaatgatcaatagcattgacttggtgcgcagttatgctgaaaaaggcgtgttggcaaatatcgttgtgatcggtcttgggactaatggaccgttttcggacgatcaattagcccaaatgatgcaagccatcggacctgatcgtcaggttttctggattaatgttcgcgtaccgacccgcgcatggcaaaatgatgtcaatggcaaattagatgctgcccaaaagcagtacaaaaatctgacggttattgactggttccataaatccgatggtcatcctgactggttttacaatgatatggtgcatatgaatccaaccggcaatcccgagtatgcggcatttgttgccaaaactattttggaaaagattaatgaatagccgtttttatgacgttctttagtgaacggtcattgttcagttaaatcgagcctagaggtcatgccattctctaagctcgattttttataatattggcgactcggtttagaaaaaatagacggcgtgaaagtctatgacagcaatgattccgggataatcgcagagaacttgtggtagactacaaagtgaagtttgacagaataggaagtatggtatggaaattcaatttttggggacaggcgcaggttcaccttccaaagtccgcaatgttagcagtttggcgctcaagttgcttgacgagcgcaatgaggtttggttgtttgatgtgggcgaaggaactcagcatcaaatcttacagaccacgattaaaccaaggaaaattgccaaagtatttattacccatttgcatggtgatcatatttttggcttaccgggctttttagctagtcgggcaaatcaaggcggcactgaaccgttaacgatttatggacctccggggattgaggactttgttaagacgagtttgaaggtttctcagagtcatttgagttatgcaattaaatttgtattgttgcgacatccaggcgtgatttttgatgatcagacctttaaagtcagttttgatcggcttgatcatcggattaccagttttggatttcgagttgaagaaaaaccacacccgggcgagttattgattgataaggtccgcgccgccaagattccggctggaccggtttatgcttcgttgaaagcaggcaaaaccgtcacattaccggatggccggacttttgatggtcatgacttcatcggatccgcgcaacccggccgaacagtggccatttttggcgacacgcgtatgtgtcgtcgggccttaccattagcagccggggcagatgtcttggttcatgaaagcacgtttggtccggatgaaagtcaactggccaagcagtattatcacagtacgaatcttcaggcagccgagttggcgaaacgagctggcgttggtcggctgttgttaaatcatatttcggcacgctatcttggccctggtgtggcaatgttagaaaaaagtgcacggcatattttcccgcaaacgcatgttgtcagagatttggaggaaattaacattccatttgcaagcccgcaactgcaaccgacagtttctgctaaatgacgattccggtttgatgagacatcaggcaagcgttgttgaagattacgggaaaattgggcaatataccgagttgaaatgcgaaaactggcgcagaagtatagggacgcgtcacgactccttactttttgacgattatcggtaccagttcacactcacacgtgctcaggagggaactttatggtgaaaaaacatctgaccgttgtcatttctggcggatcggctggcttgggaaaggcgatcggactcgaggcggcgaaaaatggtgcgacggttgtatttttggcgcggcgccgagataaattacgtcaggctcaggctgaagcaacagcgctttccggacatccggcttatgcttttccagtggatgtgggtgatccggtggcaattgaagcggcggttgatcaaattcacgaaacggttggatcggttgatgttttggttaatgcagccggttttggtcactttgaaaatgcttttgacacggatatgcggttagtcgaacggatgtttcgggttaatgttttaggtgttatgtatctgaccaaactgttgggtcgtgatatggcaatacgcggtcagggacagattattaatgttgcctcaatggctggtaaaatggctaccccaaaatcagccatttattcagcaacaaaatctgcagtgatcggttatagcaacggattgcgacttgaacttaaaccatttggcgttcatgtcacgacggttaatcccggtccgattgcgacggattttttcaaggcagccggtgctttggattatctcgcaaccgtttcctggctggcattggatccggatcaacttgcgcgccgaatcgttgggacatttgaccatccggtgcgggaaatcaatgcaccgcgcgtgatgaatctgggtgccaaactatacacattatttccaggtatcggtgactggctagccggtggtatgcttaataaaaaataaaggggtggctcacatgaaaagtcagcaacgttttattatcggactggttcttgccttaatcttgattatttttgctttactgaacggccaaggggtgtccgttaacttcttcggcattcagttagaatggccgctgattgtgattatcgcagtatccgtactgatcggtgcggtggtaacctggttaatctccaccagtgccgttgcgagcgctaagaagcagatcaaagaacttcaacagcgcgtaacggaattgaccaagacaaacaaaaacgaaaaaccggcgccgaaaccggttcaggcaccaaaagaaacgccttctgatacatccaaaaactaaacgaaacgacgcggatattttgttcgcgttttttatttaaaatagtttgaccttaactgaccaatatcgtaaagtgaatttgaaaacaatgaacagttatggaggcatgatggatgaatccagataattttacgcaagcggtggctgaagccttgggtgctgcccaacaaattgcccaagtccgccaccatcaagaaatcgatattccccacgtcatgaaaagtctggtgcagcctaatcaattagctgagcagatttatcgtgaagctggtgtcaacattcacgggttaaatgccgcgattgacgctgcgattgacgcagagccggtgattgaaggcgcaagcggatacggccaaaacatgtcgcagaatctggcgcagatgttaagtgatgccgatacgatcaaagatgagtttggtgatacgtatgtttctaccgaggcgctgttactggcactctatgagcagcgttacaacacgattacccgctatttattggatgatgccaaagttgacgccaaaaagctgcgggcagtcattaccgagattcgcggcggcgagaaagttaccagtaaaaacgctgaggctaattataagagtcttgaaaaatacgggactgatctggttaaagaagcacgcagcggcaagatggatcccattatcggtcgcgatgaagaaatccgcgatgtgattcggattttaagtcgcaaaaccaagaataacccagttctgatcggagaaccgggtgttggtaaaacagcgattgtggagggcttggcgcagcgtatcgttaaaaatgacgtgccagacaatctaaagaataaaacgattatttccctcgacatgggcagtttggttgccggtgccaagtatcgcggtgaatttgaagagcgtctgaaggccgttttgaaagaagtcaaaaagagtgaaggtcaaatcattctgttcattgacgaaattcataacattgtcggtgctggcaaagctgagggatcaatggatgccggcaatttgcttaaaccgatgctggcacgtggcgagttacatttaatcggtgcgacgacgctggacgaatatcgcgaaaatattgaaaaagataaagcattagagcgccgattccaacgggtgctggtacaagagccaactgtggaagatacgatcagtattttacggggcttgaaggaacggtttgaaatttttcacaaagtgcgcattcatgattcggcgttggtggctgccgcgacattatccaatcgctacatcacggatcggtttttaccggataaggcgattgatttagtcgatgaagcctgtgccacgattaatgttgaaatgaactcgcgcccaactgaactggacgtggccgagcgtaagcagatgcagcttgaaatcgagcagcaggcgttaaagaatgaaagtgatcccgcaagtaaaaaacgcctggaaaatgcaaacgccgaattggcaaatttaaaagaaaaaaccaataaactcaaagcacagtgggaagctgaaaagaaggacattcgccagcttaacgagaagaagtcagcgatcgacaaagccaaacacgaactggaagatgcccagagccgttacgatttggaaacggctgctcgtctgcaacacggaacgattccacaacttgaaaaagaattgcaggcaatggagcacagtgatcggccgcagtcttggctggtccaagaaagtgtcacggctaatgagattgctgctgttatttcacgagaaaccggtattcccgtggcaaaactggttgaaggcgatcgtcaaaaattgctgcatcttgccgataatctgcatcagcgtgtcattggtcaggatgaagccgtcacggcagtttcagatgcggttttgcgttcacgcgccggactgcaagacccaagccggccattagggagtttccttttccttggtccgaccggggtggggaagaccgaactcgcaaaagcgctggccgaggatctatttgattctgaaaaacacatggttcgaattgatatgtccgaatatatggagaaggcgagtgtttcacggttggtcggtgcggctccgggttatgtcggttatgaacaaggcggtcaattaaccgaagcagttcgccgcaatccgtatacgattgtcctattagacgaaatcgaaaaggccaatccggatgtcttcaacattcttttgcaagtgttagacgatgggcggttaacggacgggcaaggacgcaccgttgactttaagaacacgatcatcattatgacctctaacctcggctctgaatatttgctggatggcgtgcaaaaagacggaactgtcagtcagcaagctaaggatcaggttcgtcagttgatcggtaaagcttttaaaccggaatttctcaatcgcattgacgatatcatcatgttccatccactttcactagatgatgttaagaagattgccgttaaggatctgcatgagctgggaacacgcttggcagaccagcaaattagtttggacatcacgccagaagctcagacctggttggcggataagggctatgacccggcatttggtgcgcgtccgttgcagcgtctaattaccagtgccgttgaaacgccgttagccaaagagctcattcgcggaacgattcagcccggtcaggaagtggtcataaccgttgcggatgatcagctgcaattcaaagcaaaacaagtagcagcgaagtcataagcctgtaatagctgaattattctgtaaagacccttgccttgacgccgcttttcatgtatgattagcgttgctgtgacagaacatgtttctgtccacgcgtgacgatgattggacttgcattttgatcatcgaccgtataaagtagtttagaaatcttactaaaaaaggggttttccgctcatggcagttccagcacgcagaacgtcaaagaccaagaagcgtatgcgccgcggtcacattaagttgaatgtgcctaacttgcaattcgatgcagcaaccggcgaataccgtgtttctcaccatgtttcacctaagggttattacaagggtgcacaagtggttaagaagtctgacgacaacgcaaatgcataacaaaaagccaacatctcgggtgttggcttttttgttggcgccaaaggatggcggcactagacgtcagcagtacgtggcgttcaacatttctttcatgacgaaactgagggttatctagttttcaaaaccacatctcatgatataatacgactaaaagaggtgcgatcaatggctgataacaaacaattttcggattacttagcccagcttcaaaaagcccaatttccgcggtgggctgacttaccgcaatttgatctttacatggatcaggttattcagtatgtcaatgatattgtgacgccacttggttttggcgaaattacatcgactatggtcaataattacgtcaaaaaaggcgtcatccaagcacccgtcaagaaaaagtatcgccccgaacaattagccaacatactggtcattgccatgttaaaaccggtttttgctttggatgccattgccaaggggattcagtttgctaaagaaggccgcccggtagctcaagcttacgatacattcattttgacttttatcagtgccattgagcaggcaaactccgacttcaacgacaccgttgccattaatcgaaccgttcagccaagcaccgctgccacgcaacatgccgtggtttcgttagccatcaatgcggttttgcaaaaactgatggttgagaagctgctgacgctcacccaagtccctgctaatgagaaaggaaaaaaggcatgaagctgaccattttatcgacgagtgatacccatggctttgttttgccaacgaattatgttaaacgcgaccagaatctgccgttttcattggccaaggccaaaacggttttggatgcccaaaaagcgatggcagaagggcctgtgctgaccatcgaaaacggtgactggttgcaaggctcgccattagcctattatgccgccaagatgagtcggaagcctgaacagttgacgcaaatctacaatgcggttgggtatgatgcgggaattatcggtaatcatgaatttaactatggttccgattatttacgtcaagcgttggcgacactcaactacccaacgttaaatgccaatatcacgaaagccggtcaaccagcgtttggcgcgccatataagatttttgaacggtcagggatcaaaatagctgttctcggcttaaccaccgcgtatattccgcattgggaggcacccaaacatattgccgacctccaatttgaggatgtcattgccactgcgaacgattacgtgccgcggttgcgcaaagaagcagatgtggtgatcgttgcttaccatggcgggtttgaacgcaatttaaaaaccggcgaaccaactgaacgcttgacaggagagaatgttggctacgcattgacgcaaataccgggaatcgatgcactgatcaccggtcatcagcatcgacagttggcggcgatcgtcaatggtgtgccggtgacgcaaccgggttatcgtggtgaggcagtcggaaagataacgctgacgcttgcgcagacaacgaccggttatcaagtgacggatcagcaagcagttttggttaaagccggcacggttaatcccagcgcagttattgagcaagtagcagaaccgttaaatcaagtcgttgaaacgtggctcgatcaaccattagcacgagttgaaggcgatatgcggattcacgatccatttgcggcgcgggttaaagaagtaccttatattgaattcattcagcgggtgcaaatggcaagtaccggtgcggatatttccgggaccgccttgttcaacaatgaagggcgtggctttggctcaataatcacgatgcgcgatgttgtcactaattatatttatcccaacactttggcggtgctgcggctgactggtgctgaactgaaggccgcgttagagcagtgtgctacttatttttccctaaatgctcagggtcaattgatggtcacgccgcgatttgaacggcctaaaccgcagcactacaattacgatatgtaccaaggcattgattatactttggatatttccaaaccggttaaacagcgcgtcacgaaactaacttatcatggcaagcccgtggtcagcacgcaaacttatgacgtggtgatgaaccaatatcgagctgcaggcgggggcaattttgccatgttcggcccggaaaaggttatccgcgaaaaccaaaaggacatgactgaactgattgctgattatttgaaagctcatccggttttaaaagccgaggccgaccataactttaccgtggtaccgtcaatgtgacactgagtcatattctgcttgtcaagtggcgggtgaacgcttatgctgatgagcgtcatcattaggttaagtgaaaggaatgttccgcatgaagttttggaaatatggcctgattggtttattagcactgctgctagtaggctgcggccaacaattaagtacgacaaaggcaacttacggacgcaatggtttggttgcgacgatcaaaggcagtgcgagcggggttgatcgggttcattatactagtcaagccggtaatggaagcgtgccggtgaagagcggaacgtttgtggtcaatgtaccggtaacggatacaacccaacagatcaaactaacagcgggatcgcttaaacgtgaagtcaacgttaaggcaggcacatcactagggcagtacactgctattgcgaccaaatttaatcaaatgttggccgtttcgagtctctccaaagcagatcaggcaaaactaaagcaaggacaggcagcagcggctgagcttcagaaaagtgcggcaacgatgacgcctgcagaaaaattgacggcggcacaacaggcacagacgctaaaaacattgatggcacaagcaactgccaatacccggggcaagcagttaccaaccaccgctaaaaccggcatccagtcgattttaaaaacggctggcgtcaattatcgtgccagtatcgtcaacggtaaggcgatgggctttgccgtcgttgtgcctttgtccgtgcttaaagacagtaagaagatggaacaattcgcgactggttttggcttgttgagtacagcagtcggagctaatgctaagactgtcttctcgcacttcaagaaactgacaaaagatgccaaatcgaagaacaactcgacaacgatcaagacaattaagagtaacaatgttaagtttgatgtgggttattcaaccaccgacttgtatctttatgtaaccaagtagccaagtttaagcggttgacgataccattaaaaaagcactcgagaaatgtctgccatctcttgagtgcttttttggcgccgcttcgcttgattcacatgttcggcgcaccttacttaatgttctggtttttccgctgacttagcaaaatgttgcataatcggtgggaagaaaaataaaatgacaacaaagatcacactgacaatggcacttgtctttggatcgtaactgctgccgctcaaggcgccaatcaggaagccaacaacttggccgaggatcacgccccagatgatggtaggtaaataccgcatgaaatccctcttttctgtcgtcatcttaccacgactatcgaggaattcaactgaaattaaattattttccagtataatggaaatgaggtggcaagatgacgtttacccaattacaggttcacagcaattataccttattacacagccctttggcactgcctgatttgattcaggccgcaaaaaatcggggttattcagccgtggcattaactgacaccaatgttgtttatggcctagtagagttttatcggcaggcaaaagcggcggggttaaagccgttattagggatgcaaatcgaaattgccgatgccaagttgcttgtgattgccgaaaataataccggttatcatcaattgttgaaactctcaacccaaattatgcttgcccaacagccgcttgcatttgctgatttgctgccgctgaatgggctggcagccgtaacattgcccgattcaccttttggcgtagcagtttctgagcgtcacgaagatcaggcacagacttttctgacaacgttaaaagctaagcaaccaagctccttgtacattggtgtggatgaggaacatcttgaaggaacattacctgcgtttgcggacaccgtaaagttaccgttacttgctttggggaatgttttgtaccgcgaccccaccgatgcctttacgcaaaaggtgatggtggcaattgaagcaggaagtcaattaaactttcgcgatccggttttaacggatgccgggccagcgtggttaaaaccgccaaccgatgcggccaagccgtttgtgcaagccggcttgcaagcggcggtgacacagactgaagcaattgctgcgcgtgccgatgtgacgattgattttaaacagccccagttaccgcactatcagacgcctgatcaaacgtcttcaaaagattatttgaccaagttggctgaatcgggtttggccaagcgctttcatgggcagtcgattccgccggcttatcaagatcggttggagtatgagctacgggtcattattgaaatgggctttgcggactattttttggttgtctgggacgtgatgaattatgcgcacaaggtcaacattatgacaggcgccggccgtggttctgcagcaggttccttagttagttatgcactagccattactgaagtcgacccgattgaatataatctgttattcgaacgatttctcaatcctgcccgagcgcaaatgccggatatcgacttggatattcctgacaatcggcgcggtgagttgattcagtatgttcacgacaaatatggcaagaatcatatggctcagatcattacattcgggacttttggggccaagcaggcaattcgcgatgtcgcccgggtttttggcttgagtcaatttgaaagcaatacctggagtaaagctattcctaacttatttcatattgatttgaaaaccgcgtacgaacaaagtcagccattgaaaaatctggttgccgattcgccaaaaaatcggatgctttttcaaacagctttggctttggaagggttgccgcggcattattcaacccatgcggctgggattgttttgtcagaagaaccattgactgataccgtcgcgctccagcctagtggcgatggactcgaacagactcaggttcccaaagacgatgtggaagcactcggattgttgaagatggactttttaggtttaaaaaacctcaacatcttggcagcagcaagtcatttcgtcacccgcgatacaggcaagccgtttgaccccaaggcaatcccgcttgatgatcaacccacgctggcgttatttgcgcgtggcgacacaaatggggtcttccaattcgagtcatccggcatcaaaaacgttttacgcaaactacgaccaactgcttttgaagatgttgtagcggttaatgccttgtatcgtcccgggccgatggagaacattgataccttcattgcgcgcaaaaacggtcaggagccaattgcctatccggacccagcgctggccaaaatcctaaagccgacttatggcgtcttggtttatcaggaacaagtcatgcaggttgccaacgtcatgggtggtttcagtcttggcgaagcggatttgcttcggcgggcgatgagtaagaagaaatcttccgttctagctgcggaacaggataaatttattgaaggtgcccttaagcaaggcttcccggaagcaaccgcgaaaaccgtttacgcctatattgatcgatttgctaattatggattcaatcggtcacacgcggtggcctatagtaaagtggcgttttggctggcttatctcaaagttcactatcctgccgcctttttcgcagcattgatgaacgccagcatgaacaacctgccaaagctacggacgtatgtacaggaagctaaagcgcgcaaagtggggttacttggtccggatatcaatcaaagcaatggcggctttaaattgagccaaggaaagatccgctttgggttactatcaattaaaggcatgcggcgggattttgtcgaagccatttttgccgcccgcaaaaatggaccgttcagggaccttcgtgatttattgcaacggcttgatcctaagtggttgaaaaccgactactacaaagcaccaacgcttgctggcgcttttgaccaattcagcaataaccgtgcgcaaacgctggctaatttggatgagctgattaattccgttaagttagccggtaatgatgtcgggttattttcaatgttagcgccaaagaccattgaggttcccgagatgccggcgagcgagcgcttagaggcagaagcagaagtgctcggggtttatctctccgggcatccggttgataagtatgccccgctaaagacccagtatcgccttattaatgttagcgatcttgaagaaggacgagccgttgacatcttgctattagtccggcatatcaagcggattcgaaccaaaaccggtaaacccatggcatttatcgatggtcaggatgcgaccggtaacgtgtcattaacaatctttcccaatttgtatccaacgatcgagaatctttcggaagacatggttgtattagtcagtggccgggtcgagaagcgcaatgatgatttgcaattggtggtcaatcggatacaggatgcccagccattgttagccaatttgccgaccgcggaattgttcattcgcatggatgccaaggatacggcgatgcgaaccgatttactgaaaaaactgcaagctgctcacgggacaacccccgtcattacggttgatactgccacccgcgaaagcattttgctggataaacgttactgggtcaaggcgcagacggaactgatcgatgcgttaaagacacagtttggcgcgaacaatgttgtgttaagaaaacggcaggaaacctagagaaaattgtaaaatgttctcattttcagggactttgtttcagaaaagtggtaaactcaatgagtatttgtggtaggacatatcgcaaaagaatatgcatgaggtgaaataatgaaacgcattggtattttgaccagtggcggtgatgctccaggcatgaacgccgcggttcgagccgttgctcgcaaggcgatgcatgaaggccttgaagtatatggcatcaattatggctttgccggtttagtggccggtgacatttttaaaatgagcgagtcaacggttggtgacaagatccaacgtggcggtaccatgctgtactccgcccgttatccgcagtttgctcaagaagaaggccaattgcgcggggttgaacagcttaacaagttcggtattgaagcactggttgttattggcggcgatggttcataccacggtgcattggcactaacccgtcacggtttcaatacaatcggcttacccggcacgattgataatgatattccgtacactgatttcacgatcggatttgatacggcggttaataccgtggttgaagcggtggatcggttgcgggatacggctgcatcccatgaacggacctttgtcattgaggttatgggacgtgaagcaggcgacatcgcattgtggtctggcgttgccggcggggccgaagatgtcattatccccgaacacgacttcgatgttaaaaagattgcttcgaagttacaaagttcccgtgaacgtggtcaaaagcatgcggttatcttgctggctgaaggcgtgatgcacgccgatcagtttgccaaggaacttgctgcctatggtgatttccagttacgtgctaccgttttaggtcatatcgttcgtggtggtgcgccatcagcacgtgaccgcgtattggcttcccaaatgggtgcttacgccgttgaactcttgctgcaaggcaagggtgcgttggcagtcggcattgaaaataacaaaattacggcgcatgatgtccggactttgtttgatgccaagcaccacgccgaactttcgctctacaccttggcggaagagttaacattttaatttttgtaaacaaacgacattaacgtctgtttaaataattgcaaggagcgatttcatttatgaaaaaaaccaagatcgtcagcacacttggacctgcaagtaacaccactgatatcatcgttaagttgattgaagcgggtgccaacgttttccgtttcaacttctcacatggtgatcacgaagagcatttggcacggatgaacatggttcacgaagctgaaaagatcacgggcaaaaccgttggtatcatgcttgatacaaagggtgccgaaattcggacgactgttgaggatacccctaatggcaagattgaattccatacgggcgataaggttcgtatctccatggatgcaagcctgaagggtactaaggaaaaggttgccgttacttatcctggtctttatgatgatacccatgttggtggccacgttttgttcgatgatggcttgatcgacatgaagatcaccgaaaaagatgagaagaaccgcgaacttgtcaccgttgttcaaaatgacggtgttcttggtggcaagaaaggggtcaacgcacctggtgttgcgatcaacttgccaggtatcacagagaaggattccaacgatattcgttttggtctggacaatggcattaactttattgctgcatccttcgttcgtaagcctcaagatgttttggacattcgtgaactccttgaagaaaagaacgcacttaatgtccaaatcttccctaagatcgaatctcaagaaggtatcgacaatatcgatgacatcttgaaagtgtctgacggcttgatggttgctcgtggcgacatgggtgttgaaattccgtttgaacatgttccgatcgttcaaaagcgcttgatcaagaagtgcaacgctttgggcaaaccggttattaccgctacccagatgttggattccatgcaggaaaacccacgtcctactcgtgccgaagttaatgacgttgctaacgctgtttttgatggcaccgatgcaaccatgctttccggtgaatctgctaatggtgaatatccagttgaatctgttgctgcaatggcacggattgatgaatacaccgaagcagctatgcaggatcaggatgcttttgcattgaaggaatacagtaacaagaacattaccgaagcagtaggtcagagtgttgcacacacggctcgtaaccttggtgttaagaccattgttgctgctactgaatctggctacaccgcacggatgatctccaagtatcgtcctaaggctgatattcttgcgattaccttcagtgaaaagactcagcgtggtttgatggtcaactggggtgtttatcctattgttgccgacaagcctgccaacactgatgcaatgtttgacttggctaccaagaaggctcaagatcttggctttgctaaggaaggcgacttgattctgattacagccggtgttccagttggcgaatcaggtacgactaatgtcatgaaggttcaactgatcggttccaagctggttcaaggctctggtgtcggtgatgaatctacaatcggtaaagctgtcattgcaagcaacgctcaggaagccgctgccaagatgcaaaaaggcgacattctggttgttaagacaactgacaaagattacctgccagcaatcgaaaaggccgctgccttggttgttgaaacaggcggcttgaccagtcacgctgctgttgtcggcatcgcgatgggtattccggttgtcgttggtgctgaaaatgctaccagcgttatctctgatggtcagattatcaccgttgattcacgtcgcgggattgtctacaagggtgctactaacgcactttaatcatcatcagtttaacaacgatttttctgaaactcctgaggaaactcgggagttttttattatatcggctagataacccgctaacctgagtgccagtgggtaaaatcgcttaacaggctcgtcagtgtgattgggatagcatataataagacccagcgtgcttgatcggataaaaatataatttcagccgatgaaggaaatcggcaaatgattggaggaagatagccatggaaagttggctgtttttactagcgattcttgctattgcactcattggtaaaaataaaagcctcgtcatcggtgtggccgttgtcatggtgttaaaattaattccgcaaacgcaacatttactcaagttattgcaaagtcaggggatcaattggggcgtgacggttatatcggccgcaatcatggtacccatcgcaaccggtgaaattggctttaaggaactactgcatgtcattaaaagtcctgcagggtggattgcaattggctgtggggtattagtggcggtattgtctgccaaaggtgtcggcttgttggcggtaagtccggagatgacggttgctttggtttttggtacgattctgggagttgttttcttaaaagggattgccgccggtccggtgattgcaagtggtatgacctatgtaattttaaccgtttttaatctcttaccgggtcgttaagacggtgttgttaacatgtgaaggagcaaaaaaatgaaatttaatggtcaagtcgtcaccgcacaagtgacggatcacaatggaaaagaagtgtttgcccaatatgagggtgtaactttagcaatcgaccggcttgaattgccgacattaccagaaatcggtagtcaacttaagggccttgcgtatgaaaataaacatggccaggcgcgattgacgaccaagttgcctaaggtggggcgcgatcactacgcttttgctccggttgttgaagttcgccgagatttaggcgtctttgtcgatatcgggttaccggataaggatatcgtggtcagtgaagatcagctgccggaattaagtcgtttatggcctcagcgcggcgatcgtctcatgatcgcgctgacaattgataagaaggatcggttgtgggggaacctagctgatgaaacgattattcgtgccgttgccaatcgtgcgaaaccggatcaaatgaatgctgatgtcacggcaactgcctatcgtttgaaaatggcaggaacccgggtattgacagatgacttttatcttggttttattcatccaagtgagcgcgatgttgaaccacggctaggacaggtcctgcatgcccgcgtcattggcgtgagtgaccaaggcgaattgaacctgtcattaaagccgcgtgcttatcaagcgattggtgacgatgctgctatgattttagccgttttgcaacatgatccggcaggcaagattgcctataccgataaaagtgatccagctgtcatcaagcaggtttttggcatcagcaaaggcgcatttaagcgagcattaggtcatttactgaaggccggcttgatcaaagaagaagccggttacacggttttattagattcgaatagtcaaccatctcaggaggcatagtatgcatgggttgattgctgattttattcattatctggatgttgagcgcgggctggcccgaacaacgcaggtcagctatcagcaggatttaaccacctttatggcgtggttaagcgaccaaaagcaaacaacttttcccgaagattttggggttattcaggcgttcttaaagcatcaaaatgataccaaagcgcctgcatcagtcagtcgaatgatttcggcgttacgcaagttttaccggttcttgttacgcgaaggtgccattaaatctgacccgatgaccaaaattgatactccgaaaaaagcacaacatttaccggccacgttatcagggacagaaattgatgctttgatggcaaagccggataccactaagccgttgggattgcgtgatcgcgctatttttgagctgatgtatgcgactggcttgcgggtatcggaagttgtgggattgcgattggatcagttacatttagcaatgaacttgcttcaggttaccggaaagggcgataaggagcgactggttccaatcagtccccaagcagccgattgggttaaccgttatttgcaggaatcccgtccgcgtttgatcaaacaccagcaacccaaggcagtgttcgtcaactttcatggtcatgcgctcacccgtcaagcaatttggaagaatctgaaagcctatattgcaagtgttggcattgaaaaggacgtaacaccgcatacgttacggcacagttttgccacgcgcctgttggaaaatggcgccgatttacgggtggttcaggagttactggggcatagtgatattagtaccacccaaatctatacacatctgagtaatcagcatctagtggcggtttatcataaaacccatcctcgtggctaaccgtaaccgacaaccgttgagacgttacgggccagatcttttgttgctttgcggaaggtgactaaagtttaaatctaagcacaacggcaggtagccaaccgctattcccatggcatagtccaatttagttcacattgccccggtctcgtttctatgatagagtgtctggagagtatcttttggaggcaaatatgctggttaaatataaaaacgactatgagaaaatcgcgatgggacttttatcctttatcccggatctcaaagatgtcgggcatctgaagactgaacttaagatgtacactgaagatgattcccatgcgttgtatttgtataaacatcatcatgattttgtcggtgtggtcggtgttgaattaagtgccgattttgttttggtgcggcacttgagcttctcgccaaacttccgtgatgaggccaccgcatttgccgcattggcagaattaacaaagctttttccagataagaaactgatgggtgcattggaacacgcatcgttgatagctgcttttaacaagtttcgaaaagaggatgaccatggcactgacactcgtgctgaatgatttctccgggccgttggatttgctttggcatttgattcggactaacgaagtcgatatttatgatattccaatcgccgagatcaccacccagtaccttgactacctgcaccaaatgcaggatttagcactggacgtggccggcgattattttgtcatggccgctaatttgatggtcttaaaaagccggctattgttgccacaaccggaaccggaaacaaccgcgccagatgagccgactgatccgcgagctgacttagtggcgcagttgttgacttatcaggtgtatcaggaagcggcaaaggatttaaagcaacgtgaagccaagcgtgcccaggcttttgccaagccaacaactttgccggatgaaaagatggcggtcccgcttgctccaggaacggtcaaactaattgatcttcaagcggcgatggcgcgggtcatgaaggcccaacaggcagcgcggcaaacgattgcccacatcgaaacggaaccggtctcggtagaaaaacgcatcggtgaagttttgcgtgccttgcaacaagatggtcagtgtttatttgcggatttattagcagtcaactcggtggaacaggtcgtgacgacttttttggctttgttggaactaatgaagaatgatcaggtgatttgcgaacaagatgcgccatttgatccgattacggtgacattgaaggaggctgcttgatggagccggtattagaggcaatcttatatacggctggcgaaagcggtgtgacgcttggcgaacttgccagtatcttggaaatcagtgaaagtgccatgcgccaacaactggaggcgtatcagcaacgattggccgcagacgaccagcgcggattacaagtacaacagtttgccgatcgatattacctgctgaccaaaccggcctttgtatccgcgattaaaaaatattttgcggggccacccgctgctggtctatcccaggcagcattggaagtgttggccattattgcgtatcagcaaccgattacccggatagaaatcgatgaaattcgcggcgttcagagctccggtgcgcttacaaccttagcatcgcgacaactgattaaagaagcagggcgcaaagaagcaccggggcgtccgattctatatgccaccacccagtttttcctggattattttggcctcaatcaattggccgacttgccgccactagccgatgcacctgaagatacaggagaagtcgatctctttacggcatttcgcgatgatgatcagtcacaaatggctgaagatgataagaaaatggagcaaaaccaacaacatgacaaccaaaaatgaacgactgcaaaaagtcattgccaacgccggtattgcatcacggcgacatgcagaaacactcatcgcatctggccacgttaaagttaacggtcacgttacgacagaaatgggcatcaagatcggaccgcatgataccgttgaagtagatggggtgccaatcgggaaggaagccaagcgctatttcctgttctataaaccacgtggcgttattagtgctgtcgaagataataaagggcgcaaagttgtgactgattatttcgaggacgttcaggaacgtctttatccagtaggccgactggattacgatacgagcggtttgctagtcatgaccaatgatggcgaattggccaaccatctcatgcatccgcgctatgccctggaaaagaaatatgttgccaaggttgaaggaatccctaaccgaccggcgctagcaccacttaagaccggtgtttcaattgatggtaaaatgacggcaccggcaaaggtcgaaattttatcaactgataaggctaagaaaaccgcaattgtggccttaaccattcaccaaggtatgaatcatcaggtaaaaaagatgtttaaagcagttggttttccagtgatcaaactttctcgtgaagcttatggtaatctgaccttggccggattgcagccaggggaacaccggccaatcaaacctcaggagcttcatgatcttcgtcaattaaccggtgagcaagaagaagcacattaattgttaacgcattcaaggtaaatgcttgaatttgtgagggttgtttgctacagtgtgattgtaattaaataatttggttcgtcttcagggcagggtgtaattcccgaccggcggtataaagtccgcgacccgctttttgcggtggaaccggtgtgattccggtaccgatagtgatagtctagatggaagaagatggggcttttttgaatctgtattcaatcaaagacctattcccccctgaaggaggaataggtctttttaagttccggaagacggcctcacggaggtaatgttttatggcaagtcgttctaaggttcatcgtttggtgggcattgcacttttggcggcaatcgggtatgtgctgatgatgttttcattcccgattattccggcatttccctttttaaagttggatttgtctgacttggttgttcttttagggggattactttacggtcctgttggcgggattgctgttgcgtttgttcggagcttggttcacttcgctttaactggcggtggtgttgttaacctgattggtgatttggccgcctttattgccagtgtcggcttcttgttaccagtcgtttatacgattcgcggtaagcatcggatttggcggcagattgaagggctggttttagggaccttgagtttgacagttgtgatgagcgtgctgaactggctggtgatcaccccgatgtatatggctgtcttcaatttcaatttagggatgtctttgactaaatatgttctaattggggttgtgccatttaacttaatcaaaggcgtcgtcatttcagttgccttctttgcaattgcaaaggcactggctccatggttagcacgtcaggaaatgcaaatgagccattaaaagctgttccggttttcatttgactgatcggttcacttagacaagcaaaaagcatccaacttgcgcggatgctttttgtttgcctgaaaatgttagcgacataaacgttaacaggaatcaatgcgtaatttatcgatagcggtctaatttggctggccggttacgcttgattattccgcttttgttggcgtaaacggagccgtgttaaacgggtggtcactgcgtttgatggcatgtgtcgggcaacgctgatacgcaagccgaaaatcaatttttgcatgatcatccagtggctttgtgccagtgttgcgatcaggcttataataagcaataccggcttcgtcatagtcaaacaaggctggtgccaacatttgacacagtccacaagcaatgcattcgggacgttccactctgccatataatgccatgttaatagaggactcctttataattttcagtttaaccacacccaagtatacaataatcaatgaaaaagaggtgactggcttgttgacagacttggccattcaattttttgatacccagccacggcgagagcgagctgtattcggcctgttagccggtaagaaaaccatttcaaatctctatgccgctttaacccaccagcaattgcaatggttgcagctttatccaagcctgtctaaagagttgtttttacaggcagtggcgcagttaaaaatgcatggtcagttaacaacgacagaaaccgggttggtgttaaccgcaaaaggccaacagtttcagcgtcaagcggcaaaacgggtgccattaccgacctactatcagccgtggatgcacctggcaaaatttgcgccgcggttctttttggccattcaggttttgtcagaagccagttaccactcacaggcatatcgtccgattagtaccgattgggcgaatcagcaagcggttaaacgctggtatcgccaactgaatatcgagtctgcgattgcggatttgattgcgctttttgaacggttgccgccgcagttagctgacatactagcggctaatctaattggtcacgattatgctggtcaagcgcaaccacctactttaagcgcacatttcagccgcatcaatgctttggcagccttagttaacgagattgcggcaattaaggatgaaggcaatccgtggtacgagctatggggcggcccgcaagatctggtgacgcgtccggcacgttatagtttacagcaagtccaagccggtgttggcttaaaggcgattgcaagtaaaagtcaccgtaaactgagtaccgtgaaagagcatttgctgctggcggctatcatgggagagtcgcttccggtcgaagaattgattccgcaaccgatccatcaagcattggatcagatcgatcagtggcaagatcatcaagtcttattggatacggttccagccactgatttctttcaggtacgcttgtttcaaatcttgaaattgcaagggagatggtcgcgtgtcgcaacttgaaacggccttggcgcagcattttggctttaaacagtttcgtcctggacaaaaagccattatcgaatctgttcttagtgggcgtgacaccttaggcattttacccaccggcagcggcaaatcactttgctatcaattgccgaccttaattaaccataaaccgactttaattgtcgaaccactgattgcattgatgcatgatcaagtgggaaggctgcaggcagcgggcgaaaaacgcgttttggcattatccgggcaaattgcgccgccccactttgctcagattttagcgtatttgaacgtttatcgctatctgtttatttcccctgaaatgctacagcgaaccgatgttatgtctgcgttgaagcagctagatcttgggctgctggtaattgatgaggcacattgtatttcacagtggggaccggattttcgtcctgcctatttacaactggggcgagttagggcgcagttacatgtggatgccgttttagcgttaacggcaactgcaccgaatcaagtccgcagcgatattttaaaccaactggcaatgcaaaatccgaatacaattgcggattcagttgatcggcctaatatttttctgggcgttgagatgtgtcaaaatgaacaggagaagcatcagcgcctagttcaactcttgcaagccaatgtcggaccaacgattatttattgtgccactagggcagcagcggaaaacttggcaacggtgttaaagaacgcgggattgaaagccgctttttaccatgccgggttggattcacatcaacgtgatttgattcaacgtcaatttcaatttgatcaactgcaagtcatctgtgctacgagcgcatttggtatggggatagataaggctaatgtgcgcttagtggttcatttatatgtacccgagtcgcttgaagcctattatcaggcaatcggtcgggcagggcgagacggagccgcgagtctggctgcaatgattgtgacgcaagatgacttgaatcgaagccggggactggcggggatgttgccggatcagacgatgatccagacagtttttgcccatcctgatatttatcgcgatttcgacgatcctcagataaatctgatcgaagcctatattgcagctggtttttcgctggcacaaacgcaacaacaattgcagcatcggctagcagaaaagcaaacaagttttatggccatggccgcatttgtcaatgaatcaggttgtcgccgtgcactgttactcaagcactttgattcaccgtccatttcacatcatgccttttgttgcgggccggtgacggcggaagtgctagagaagttagagacagcgaatgtatcggcacagcttccgcctaagcactggcaggcagtttttaggcaaatctttagataagcggcgtcttgatccggttcaatatgatacaataaatccatgtagtgaggaggatcgtgatggcggaaaaagataaaaaccaacatgataacgcggatcaagaacaacatcagggtgaggatgccaataagccttgggaaacccttttcgatgacgaccgtgacgatcagggcaatttaagccgagtcgccacccgtaagaagcggcaaggtagttcgaagctgacttggatattggctattttgctgatattggcagttttagcaccgattatttattataaagtcatggataatcaaggaagcagcggtggcaacctgtcaaatgacaaggttgtgattcaaagcgccaaaaagaccagtcattcatccaagaccaagaaatccgccaagtcttccaaaacgtctaagacttctaagacttctgcaaaggaagcctcaagtagccaacaggcaacatctgcgcaagcgagctcaaaggttagtcaagcacccagcgcctcccaaaaccaggagcaggcaagcgcgtcagcagcaccaagtcaggccagtacggctggcaactcctatacggtcaagtcaggcgacaatctttatcggattgcggttaaccacaacatgacgttggacgagttgttacagttaaacggtcttagtgccaactccggaatcacaccgggaaccgttttaaaagtgaaataatagtgacacggccctgttcggatagttaaatcgatgaacagggttgtgtgttgtggaggaagttcatgcagattgcgattgacggccctgcaagtgccggcaaaagtacgatcgcgaaacttgtggcaaaaaaattaggttatatttattgcgataccggtgcgatgtatcggactgttacttatatggcgcttaaagatcagttgccattggatgatgaaacgaccattttacagcatttgagtcagctgcagatccggtttgcgcctggcgatccagaacaacgtgtttttatgaatgatgaagatgtgacgttggcaattcgtgaaccggacgtgacaaataatgtttctcaagttgctgctttgccaggtgtccgaactgaattggttgagcggcagcgggatattgctgcaaaacatgatattgtgatggatggccgcgatattggaacaaccgtcttaccgcatgcggcgttgaaaatctttatggtggcttcggtgtcggaacgcgcaaaccgtcgctacaaggaaaacgttcaaaagggaattaaaacgccacttgccacgctggaagcggaaattgctgagcgtgaccgcaaagattcccagcggaaggtttcaccgttacgtcaagctgccgatgccattcgtatcgacacaacgcgtatgacaattgaagaagttgtcgcgaagatattagcattggttgcagaaaagaagcaggcagattgaccagagcaaaataagcgctggtaatttgattcgttttcaagtacaatagatccagtatacagctgcataggaggattttttggcatgagtgataataacgttaatgagaacaccgaaacaatggcggacgcccttaagagtgtcaccacagtaaagattggtgacactgttaaagcagatgtccttgctgttgaagataaacaattgatcgttgggatcgaaggaacaggcgttgaaggcgtggtcccgatcaaggagttatcaactcagccaatcgatgacattcacgatgttgccaaagttggcgacaaacttgatttagttgtgctttcaacggttggcaaagataaagaaaatggtcagttcctactgtccaagcgccgtctggaagcacagaaggtttggaaagaaatccaagctaaatacgaagccggcgaaaccattaccgcaccggttaccagtgtggttaaaggtggtttggttgttaacgcaggtgtccgtggattcgttccggcatccatggttgaagaccacttcgttgaagacctcaatcaatacaagggcaaagagcttgaatttaagattattgaaattgaacctagtgaaaaccgtttgattctttcacatcgggcaattgttgaagcaagcaaagccgaagcacgcaaagaaatctttgcaaaaattcagcctggtgatgttgttgaaggcaaggttgctcgtttgaccaactttggtgcctttgttgatcttggcggtgttgatggtttggttcatgtttctgaaatttcatttgaccatgttgataagccaagtgatgttttgaaagtgggacaagagattaaggttaaggttttgaatgttgaccctgaccgtaaccgtatttccctttcgatcaaggcaaccttgccacaaccatgggatgacatcgaagaaaaagcgcctgctggctcggttttaaccggtaccgttaagcgtttgacaacttttggtgcttttgtcgaagtattccctggggttgaaggacttgttcatatttcccagatttcccatgaacatgttgcgaccccggcggatgttttgaaagaaggccaagaagttaaggtcaaggtgctttcggttgatccggatgctcatcgtctggcattgtccatcaaagccttgcaggatcgtccagctggttccagcgatgcgtctgagggtcacgaaggcggcaataacggcaatcaggaacgtcggcgttcatcccgtcctcgtcgtggtaacgatcgccatcagtcaagctcgatccctgctgaatatcagcaagatgattctggcttctcactcggcgatatccttggtgatgcgttgaaagatgccgctaaaggtaacgatgatcaggatgataacaagtgattttaccatccgttaaaaagttgagccttggctcaactttttttatgctaacgctgctgtttataatttatatactggcagtgagtgaactagatcatgttaagctaccaataacaaacttggttaaagaaaggaggccgtgatatatggtcttaccaacacttgctattgtcggacgtcccaatgtcggtaaatcgacaatttttaatcgaattcttggtgaacgggtctcaattgttgaagatactcccggcgtcacgcgtgaccgaatttatggcaaaagcgaatggctaggaaaggaatttgcggtgattgatactggtggtattgatctcggtgatgaaccttttttagcgcaaatcaaagatcaagcagaaattgcgattgacgaagccgatgtcattttatttttgaccagtattgaagcaggcgtgactgacgcagatgaacgagttgcccagattctttatcgggccaataagccggtcgttttagccgtgaacaaggttgataaccctgaacgccgccaagacatttatgatttttattccttgggttttggcgagccgctaccgctttcaggtacgcatggtattggcttaggtgatgttttggatgcagtcctagcggcgtttcctaacgaagccagtgcggacgaggatgattcaatcaaattcagtttgattggccggcccaacgtcggaaagtcctcgttggtaaatgcgattctgggagaaaatcgggttattgtcagcccgatcgagggaacgacacgagatgccattgatactaaattcgaagctgacggtgaaacttttacgatgattgatactgccggcattcgtaagcgtggcaaggtgtacgaaaataccgaaaaatacgcggtgatgcgcgcgttacgggccattgatcgttcggatgtggtgttattcgtgatcaatgcagaagaaggcattcgggaacaggataaaaaagtggccggttatgcccatgaagccgggcgcggcattattattgtcgtcaataaatgggacacacttgaaaaagataatcgcaccatgaaagactttgagaacttaattcgtcaggagttccaatatctagactacgccccgattatttttgtttctgcgaagacacatcagcgtttacagagtcttccggccatgattgtcgaggtttcagaaaatcaaacccggcgaattcaaagcagtgttttaaatgatgtcttaatggatgccattactgttaccccaacaccgacagtcaatgggaagcgtttgcgtatttattatatgacgcaagtggccgtcaaaccgcctacattcgtggtttttgtgaatgatcccgatttattgcatttttcttatgagcgtttcctcataaaccagttacggcaggcatttgacttttccggcacgccgattcatgttattgcgcgtaaacgtaaataaatttgacaatttctgacaatgacttttcatttaataaatcgtgattttcgataaaggtttcaaggatctcagccaaaaagtttggcaaaaaccttgtcacaacgggcttgctatgctatgtttaaacctgaaatgatgatacataattatcattgtttcttcattcctgagcggtcaggaatgagcatgtttagatgttcacgcatctaatcaattatggaggtgaaatattcatggcaaacaaagcagaattgatcgaaagtgttgcaagtgcaaccggtttgaccaagaaggatgcaaccgctgctgttgatgcagttttcggttctatccaagattccctttcaaagggtgacaaggttcaattaatcggctttggtaacttcgaggttcgtgagcgcgctgctcgtaagggtcgcaacccacaaactggtgcagagatcaagatcccagcatccaaggtaccagcattcaagcctggtaaagcacttaaggatgccgttaaataaacggttttctgaggcaacaatgaagtaacaccaaaaaccgagtcttaacggactcggtttttgcgcgttttggcgaaagccgtttccggtgatggtcatcaggagcattcaaaatcgtcagacgcgtgttagacttacactagatagcgttcatatttaattattaagtcacggaggcagctatgagttacgcaaaaaagatgctggatgcactcgaggcgggacaaatggaaacagcgcgccaactgtttacgcaggttctggcgcatgacgatgacgaaacccaatacaatctggccgaagaactttacgcactgggattcaacggtcaggctaagcgtttgtaccagggcttgctgggccgttacccggagcaaggggatttagcgaccgccttggctgatatcgcggtttctgacggtgatgccgatgcggctttaaattatctcagtcggattcagccggatgatcccgcttatgttcaaagcctcatcagtgcggctgatgtttatcagtcgttgggattgtatgaggttagcgaacagaagttactaacagcgaagcgactggcccccaaagagccggttgtgacgtttgcactaggcgaattttattttgactggggacattttggtcaggcaatcgcggcttacaacgaattgcttgctgggggtacaaaagaactggccggtgtgaatgtcgaagcgcggcttgccgccagcttggctcaaaccggtcaatatgaagatgccgttgctgcgtatgaagacgttggcgttgacgcattggatctgaatggccggtttgaactaggtggtttgtacctgcagctgcacgatccggctaaggctattgcgaatttgcaggcagtgattgataccgatccgagttatgccaatgcctatttacccttagcaactgcctatgaggcacagaaccagcctgagaaggccctggatacggttcaggccggggttatggttgatgatacgaatccggacttgtacgcgttaggcggcaaactagcgcttagtgaggacaatcctgatttagcggaaacatatttacaaaaagcattgaagatcgatcctgaagatcaaggcaatatgttggcatggagtaattttctggtgcaagaagaacgtgatcaggagaacattgattttcttagtcgcattgatcaatccggcgatgttgatccgcaaatctactggaatatggccaaaagctacgatcggctggataacgtcaaaaaagcccgggaaaattacctgttagcgtttaaccgtttccaggattcgccggactttctacatgatttaattgatttcttccagtcaaccggagcccgtgccgagctaaaggcagcgctggttcgttatcttaaactggtaccgactgatgatgagatgcaaatgcggttggacgatcttaatgatgagacgtgatccggtttcggtcttaggttaatggccgaataaaaggcgtcggcgtttcttttgataagtgaacccttcacccagtgcttcatggacatccagaatgctaataaaagcacgcggatcaatggcttcaatcagccgttttgtgtgggcaatttcgctggaagccaccacggcgtaaacgacttgcttgcggtcatgggcaaagccgccttctgcatgcaaaaaggtcgttccgcgttcaagctcgtccataatcgccgtggcaattgcctggctgtggtccgatacgactaagacacccttggcagcataggcaccatcaagcgtaaagttgacgatgcgcgagaaaacgtaggcgccaagcagcgtgtacatcatgagctcaatgtttaagtatgtcagggaaacggtcaagacaatggcatcgaatatgagcagcgttcgccccattggcacgccggtttgctgctcaaggatgcgggcaacgacatcggtacctccagtggttccgccatgtcgataaataatcccactaccaaagccgccaaaaagcccggctaaaaccccggatataaacaagtcatggtgaatatcaatgcttaagggcacccgttgccaaatccacaaccaagcagataacatcaaagttccatagatggtgtaggctaaagcacgcttgcccaaaaatttgtagcccacaatcagcaagggaatattcaacaaaaccgtgctataagccggatccagaccccaccagtaacgaatcagcagagtgatcccggtgacgccaccttctgctaggtgattggcaatattgatatacacgagtccaaagccgtaaagcgcacagcccaaagtgatcactaaaagatccagtccgattcgcgtgttacgtgacatgagatgcctccctgaaaagattttaagctcattttaacagagattttatttttcggtatgattaaggggaggtgccggacgaaagtaagaggagaatttgatgcaattagatttaaaccagccagattttaaagcagcgatcccgatcttgaaaaaaatcgaagcagccggatatgaagcctattttgtgggtggcagtgtgcgagatgctttattgggactgccgattcatgacgttgatattgccagttccgcgtatcctgaagaaatcaagcggatttttaagcgtaccgtggatactggcattgaacatggcacggtgatggttctggatcatggcactggctatgaggtgacaacgtttcggaccgaatcggcttaccaagattttcgccggccggatcatgtgacatttgtacgctcgttagctgaagatttgaagcgccgcgactttaccattaatgccttagcagtgcgccatgatgggacgattattgacttatttgacgggttaacggatttaaaaaatcgccaattgcgcgctgttggcgacccgcatgaacggtttcatgaggatgccttgcgaatgatgcgtgccgtccggtttgaaagtcaactcgggtttcatattgaagcgacgactaaagccgcgattgccgctaatgcaccattattgaagcatatttcagtcgaacggattgctgcagaattcaaccggcttttggttggcattgaccggcgtgccgggatgcaagactttcttgatacgcacctgtttgcctatgcacccaagctagcgcctcatcaagcagcattgcagcaatttagtgaattgccaaatcaagcgttcacaagtattgccagtggctggacggcgttgatcttcatgcttaaagtcgcgccggaatcgtttttgcctgcgtggaagcaatccaatgacttgatgggtttagttgaccaagccgtgaccttgttgcggaaaatgccgactccgactgcttgggatctctacagcgccggatcagcagccgtggccgtggtcagtgaagtcgccgcattgatggatcaccagtttgtcccggcatcgctgacgactgcttatgaagcgttgccgatccattccaaaaaaaccttagcactgactgggcgtgatttaattcaagctggcgtacgcccggggccggcgatgggcaagattttgcatcaaattgagtaccgcgtggttgatggcagcttgccgaatgattcaaaaaagttgttagctgcagctattgaaatgtctcgagaaccgtcgtaagtgtgttatgataggcatgtaagcacattcaacaacatcatgaagggcgaccatattagccgtaatgcgcgtgaaagtatccggttgattgttgctctgacttgatggcgaagggggatttccaatggcagaacatgtttttgaacagttagtttttcattttcgtaatggtgacgaatggacggtgcaacatgatgaattggcagatgtctggatcagtcgggtgacgaccagttacggccggattcacggtggccagattcaagaaattcatccatgcaagagctttaaggtcgagatcttgcctgaagccgaccacgttaagtccagtgatattaacaccggctcactggaaatggggatgtttgggcgcgcaacaaagtatcaggacattgaaaagatggatctggtttttgatgatcagaccaaaaagcaggttcagatttattttccgttcaagcaaaaagatccaagcgggctcgataatgaatatcaaacgagcaagcttgccaaaaatggccacctttacattgtgattgatgctcagcataccgtggatgatgaatatccgcgaatttaaagcggcctgctaaactttaattatttcatcaatatcaggggcgtctgattccagtacgagcgattgaccgcttacgactgatcacgcgccccttttcttgtgccttgcttcttgctaagatggacaacgacaggaaatgagggacgacatgcagacgctaacagcacagggcctgagcaaggcttatggtgataagcaattattcaatcaaatcgactttttgattaacgaaggcgagcgaatcggtttgattggggtgaatggtaccgggaaaacgacgctcatccggtctttagccgggatggaatcggttgatgccggtacgattaagaccccaaagcagtatcgcatcagctatctcgcacagattccggagcttgatcccgacttaccgattatggatgcaatctatcatggtgattcaccggtttttcaagcaattcgccaatatgaacgcgctttggctgcctatacaaaggatccgttaaatcaagcaaaaaccgatgcctacaccaaggccgatgccaaaatgacgcaagaagatgcgtggtcggcggaaaccgatattaaaacgatcctcacgcaattgcacatcggcgacttaacggcacgggtcggcagtttatctggcggccaacaaaagcgggtcggtcttgcccaggtattaatcgagtcgccggatttgttattgttagacgagcccacgaaccaccttgattttgactctattgcctggctggaaaattatttgagtcattatcgcggcgccttggtcgttgtgactcacgaccgttattttctggatcgcgtaaccaatcgtattttcgaattagaccgcggtcggcttttccagtatcaaggcaattaccaagcgtatgtcgccaaaaaagcagaacaactggaagccgaaaagtcggctgggcataagcaggcacaactttatcgccaggaactggcatggatgcatgctggtgcccaggcacgatcaacgaaacaacaggcccgtattaatcggttcaaggcgctacaaaaagcaaaagacgaagcaccggcacctgaccagcagctggatccgattcaaatcgcaagtaccagactaggcaagaaggttattgaaatgcatgatgcgagcttgcgatttgatcagcaggtcatcttaaatcattttgattggctggtgcagccgaatacccgcatcggcattaccggtcaaaatggtgctggtaagtcaaccttgctcaatattattgcaggtaaacaagcgcttgatagcggcaccattgaattgggggagacagttcggttaggttactatacgcagcttaatacgaatctggatccaaaaaagcggatcatcacctacttgcaagaagtgggcgaagaagtcgtgcaggcagatgggcagcgcgtttcggtgactcagatgctggagcaatttctatttcctcgcagtatgcacggcactttgattggccgcttatcaggaggcgaaaaacggcgcctatatttactacaggtattaatgcgccaacccaacgttttactgttggatgagccgaccaacgacttggacatcgccaccttgaccgttttggaagattatcttgatcatttttccggcaccgtgatcaccgtgtcacacgatcgttactttcttgataaagttgcggatcagctgcttatttttgatggtaatggccgaattgaacgcgccgtgggtgaattttccgattatctggcaaaacaaaaaccgcagtccgctgcatcaaaaacagactcagcctcggccaagccaaaagcaccggcaaaaaaagcggcgccaaaacagaagtcaaagctgacatatgctgagcagatagagtatgataagctccaacaagaacttgatgaattagacgagcagttggccaaggttaaagcagaaatggcgcaggtcaatggtgaggattacgtgaagctgggcgatctgcaggcacagcttgatgcgattaatcaggatattgaccagaagttcgatcgattcgccgagttggatcaatatgtgtcaagtagtgaacggtaaaggagcagagcagacaatgttagaacagccatatcttgatcttgcaaaaaaagttcttgatgaaggccacttcaagcctgatcggacccatacaggaacttacagtattttcggtcaccaaatgcgtttcgaccttagcaagggctttccattactgacgaccaaaaaagtaccattcggccttattaagagtgagttgttgtggtttttacacggtgataccaacattcggttcttactccaacacaagaatcacatttgggatgagtgggcgtttgaaaaatgggtgaagagtgatgaatatcgcggcccggacatgactgactttggacatcgcagccaaaaggatccggaattcgcggcagtttatcatgaagaaatggctaaattcgatgaccgggtgcttcatgatgatgcttttgcagccaaatatggtgatcttggcttggtttatggatcccaatggagggcttggcatacgagcaagggtgacacgatcgaccagttgggggacgttattgagcaaatcaaaacgcatccctattcacgacggctcatcgtgtcggcatggaatccggaagatgtcccgacaatggcgctaccgccttgtcacacgctctatcagttttatgtcaatgatggcaagctgtctttgcagttgtaccaacgttcggctgacatttttcttggcgtcccgtttaatatcgcgtcctatgcgttgttaacgcatctggtcgcgcatgaatgtggccttgaagttggcgaattcattcatacattcggcgatgcgcatctttacgtcaatcatcttgaccaaattaaagagcagctcagtcgcacgccgcggccggcaccgactttacagttgaatccggataaacatgatattttcgactttgacatgaaggatattaagttgcttaattacgatccttatccggccattaaggcaccggttgccgtttaatcgctagaagacggcaagtcataacaagtgtctgattgctttgtcaggtttaccaatgacacaacaggcgccattttgttcggctttggattgcatactcaaaggaggggtctcgaatgaccgcatttttatgggcacaggatcgcgatggcttaattggcaaagatggtcatttgccatggcatttacctgatgatttacattatttccgggcgcagacagttggtaagatcatggtcgttggtcggcgcacctatgaaagttttcctaaacgtcctttacctgagcgaaccaatgttgttttgactcatcaggaagactatcaagcgccaggtgccgtggtcgtgcatgatgttgcggcggtttttgcttatgctaagcagcatcccgatcaggaactggtcattgctggtggtgcgcaggtctttacggcgtttagagatgatgtcgatacgttactggtgacacggttggctggcagttttgaaggcgacacgaaaatgattccattaaactgggatgattttaccaaagtctccagccgcaccgttgaagataccaatccggcgctgacgcacacttatgaggtttggcaaaagaaggcttaagcagaagccgatgaccggaattggtggttgccagctggtgcggttgtgagttaagacgcatatttgcgtgcacttaaaaaatcgtctctcgtacagaagaggcgatttttttgtcgtttattttaattaattattttacagatagaaataaatcgataagtacatgcacaggctgccgagaatcacaaagaggtgccagataacgtggatgtaagggatgcctttttgcagataaagcatcgctccgcctgtataggccacaccaccggcgactagcagccaaaaaccgactgggcccaaatgatgccacaatggaaccatgccgactaagcaaagccagccgaggacaacgtagatcatcgtttccagatgcttgaagcgattcagaaagaaaagtttgtaggcaatgccgccaagacataatgcccagatggcgattagcagaccaatgccaagtttcccgccaatagcgaccaaacaatatggcaggtaagaaccggcaatcagaatgaagacacctgaatgatcaagtacctgcaaaacatggcgcgccttgctaaaataaaaaccatgaaaagcagtcgaggcggtgtaaagtaacatgagcgaaacgccaaaaccgataagactgaaaagttcaacctgactgccgctattgacgcctttaatgcctaacgcaatggtgccggttacggctaagccaagtgcaaacgcatgggtgatggcgctaaacatttcattgttaaattcataatgacttgattttgacacgcgcattgtttacctcctgatgaacatttgtatgggtggggaagctggcaggcttgcaaccacagcatcgcttaaatcaggaactcgatcgtttggctgctacctgtttattaaaagtttagcatgttgcgttttacaatacaactaaatctagttatgacaactaggtgatgtgtactgacattgtttaagtagtttgctataataatcacgatagacgaacctaacagaaagcgtggctcagacatggcaaatatcaagatcgtcacggattcttccgttcagctgactccagaagaaatcagccaacacaatattacggttgttccgttgaccattatgattgacaatacggtttatattgatggtgaaaccattacgcgggaagactttatggacgagatggcagcagcgcaaaatctgcctaagacctcgcaaccggcgatcggtacgtttaccgatgttttcgataaactaacggcagacggcagccaagtattgtcaattcacatgacagaaaccatcagtggcacggtaaattcggcacgacaggcggctcagctggtaaaaggcgatgtgaccgtcattgattcgcaatttaccgatcgctcaatggcatttcaggtgttggcagccgcagaaatggccgaggcaggtaaagacatgccaacgattcttgataagctcaagcaaattcgtgaccatactatcttagtgttgggcgtgactaacttagataatttagtcaaaggcggccggctcagtcgcgtttctggcttgatttcgtcattcttgaatattaaagttgttttgcaaatggaacatggcgaactgaaggccttgcgtaaaggacgcggcatgaagacgattaataatttcgtgaccgaaactatcagcaaaatggccaagctgaccgatattcaaagtattggcgtatcaacggcaggtgctaaagaaatcggtgaggatatcgggcggcgattagcagaagtcttgcccaacgttccgattctggttcgaccaaccgatccggtcatcgcaacgcataccggacccggtgcctttgccatcacttattacactgattaattttaaaataaatttaaccggccggcgtcagcgtcggctttttttaatgacaatggtatttgggtgacgattgcctgaagtaatgcctcacctatgagtcgggaaccggtgatagggttgcgattgttcgctcgaaaaatacagctgctgaacctgatgcgactagcggagaaacactaaagcagcaacctttgtttattcacgagacctcaagtaaaataatatattataacttgttattcatgtatttatgggaggcaacatgcgtacattaaaaaatttctttatttcctgcggtgtcttgctgctcgcttgtctgctcgcgtttggtggatggcaattattcggaccagtcagttcgccaagtgaagtgaaagttgttgccaacacccccaaacatttgcagttgacggcactcggcgattcattgacttatggcgttggagatgcgactaataatggtggctttgtcggactgactaaaggtgagctggaggcaaccgggcaatatcaagtcaccacgaagaactatggcgtcagtggcaataccagtgggcagattctcactcgcgtcaataagcagcctaaaatccgggcagacttaaaacgggccaatattattacggtgacagccgggggcaatgatttaatgcacgtcttgcaaaagcattttttgacgttgtcggaaaagcaggtgacggctggtagtgttgcatttcaaaaacggctggcaacattactgacaacgattcgcaaagaaaatccaactgcacccatttatgtttttggcatctataacccattttatgtttatttcccgaagatgacggcgatgacgaatagtgtgaaggcctggaaccaagcaacgcaaaagaccttgcagcaatttgatcgcacgtattatgtggatatcgacagtgtgttatccaatggcgaaacagcagcaaacaaggcatccgctaaagaagcgcttaaagaagcgacttccggtgatggcaatccgctgatcttttcacaggatcattttcaccctaataatgccggttatgggcagatgacgaaacagctcatgaagcaaatgaaagcaactaagaaagcgtgggagtaagaagatgcaggcaaagaaacgatcgcttcaaagaaatgcggctaaacaaaaggcggtgagaaccggaattaattggtggaaatggttatttcttattttggtcgggctattgcttggaaccgggatctggtttacgaagaccgcactgatgccagtcaagatcaactcgaccccccaaacgaccatgacatccaaagacccggtatttaccgtcaaagtaaccaaaaacagcgccaatcgaattatggcgcattatctgaaatcatacctgaaggacagcaagatcaaatatgccgtcactttgggaaccaatgaagcagcgttaagtggatcgttcaaatttctagggaatgccgttaagttccagttaacatttgatccgcttgtgttgaagaatggtgatgttttgcttaaagccaagaacctgaatatcggcgcattgccagtaccaatcagttttgtcatgagctatattggcaacagttataaaattccaaagtgggtaagtctagatagtaaggctggtacggttgtgctaaaattgacccaatttaaactccaaaatggcatgacccttaaggcaaacaagttggatctgaccaatgatgatcttgaatttgcggtttatttgcctgatgaagagtgaccattagaaagaagttgaaacaataatgaaaaaagaaacggctatttttgcaggcggctgcttttggtgcatggttgagcctttcgaggagcaacccgggattttgaatgtggtttccggttataccggtggccatgttgccaatcctacctatgaacaggtttcttcgcataccacgggtcacacggaagccgtggaaatcacgtttgatgcggatgtgatcgattatccgtcacttttgaatatttactggcaacaaaccgatccaaccgatgcaatggggcaatttcaggaccgcggcgataactatcgaccggttattttcgtcaaggatgaagcacaacgacaggctgctgaagcttcaaaagcggcgttggaagccagtggtcggttttctgatccgattgtgactaaaatcgaggcagcgaagccattttatcctgccgaaccggagcaccagcaattttatgccaagaatccgcggcggtatgcaatggagcatgcgcagcggcaggcgtttatcgacaaaaactggaaggattaatcatgcatcggactttttacgagtatcttatgacgctgcgtaaccccaatgaccacagcgaggtagcggaatttgccaaaaatgctttcctggatcaaagctttccgaaacatgaaaaagattatcatcggttaagtgattatttagaactcaacggtaattatttaccgacgatggccatttttgacgaaacataccgtgattacgaagccagtgaaagcacaggaggcgattcatatcaataaacacaaggtgccattgtgggcggtcattgttttattcctagttgcgcttggtggcggtgcggcaggtggttatgccctgtcatatcagcaagcacaacagtctgtccttaaaaccggagttcccaaagccttagcaccggtgatttcggcctatgaaacggttacgaataattattataaacaggtcagcacaaccaaactgaccgatggggcgatcaagggcatgttaagttctcttgatgacccatattcggtttatttgcaaaacaatgacaaaaccaatttagacgacaccatttctgcttcatttggcgggattggtgcaaccattcagcaggatcacaacagcctttccattgccagcattctaccgggaacaccggcgaaaaaagcaggtatgaaggtcggcgatgtgctgcttaaagtgaatggtaaagatgtgtctaaaaaaaccgtcacccaagcagttgccaaaattcgtggcaaaatcggcaccacagtagcagtgaccgttaaacgcggcagcaagcaggccaccttctccatgaagcggaaaaagattaccgttgacacggtgatcgggaaacttgcgcctgcgaataaacaggttggggtcattacgatttcgaccttcagcgaaccgactgttaagcaattcaaagcgactgtcaagaaattacgcaaagaaggcgctaaatcctttatcctggacttacggcaaaatccgggtgggatgatgacggctgctttgtcaatcagctcgatgttctccaaaaacggccagaccgtcatgcagattgaagatcgcaatggtgcaaaggaagtctacaaagcaggcaaaaagcttgatggcggcttcaaagtgactgaaaaaaccgcggtgcttattgatggtaattccgcctctgccagtgaaatcaccgcagcagcactgcaccagaacagtcaaattccgctagttggcgaaaagagctttggtaaaggcaccgttcaaaatgtcggcgagatgagcagcaacaaagaactcaagctgaccgttgccaaatggttaacgccagatggcacctggatcaaccacaaaggtctaacgcctgatgtgaaagttgcttacccagcagcagccaaaataacgttaatcaatgcaacccaactcaaacccggtgacaagggcagtgatgtgaaatcgctgcaacagatgctaaaagccttaaagatcggctcagctacggtcaacggtcaatacgatgatgcgacccaggccgccgttaaatccttccaggaggccaacgagctggacgcaagcggtactgccgatcaagacaccttagccgcactggcacaaaagctcagtgctcaactgacgaaggatgatccgatggtagcggctgctgtcaaggaagttacgaaatagttcgtttgaatcaatatcaatgcgcgcgcatgcctttgagggtgtgggcgcgtttttaatctgctaaaataaaaaagataacgaaaggagaaacctctgtttgattgaattagaaggctttgcagtgtatccaaacaaagttgagcgagcaaaagaatggatgtcttttttaaaaggtcatcaagaagcagtcaacgagacccttggccctgagaacatagaagtggaacgtattttttctgtttcagttaatggacggatgtacctttgttggtattctgaacagacggcgcccattcctgatgttacccgcagcactaatccgattgatcaggttcatgtcgacttttggaaagaatgtatcgatgagaaagcaccaaggcttgaatttaagctggagaatgagtttaagcggccaggtgtaaattaagacaattaatgtggaagatttaaatccggctattccgatcgatcaatatagtgcaacgatttatggaaaataaaggggtgaatctgacgacttattggaagtatttgaacacaatagtggtgttgatcgtattttttcttatatctctaatctttgcgagtcacacaatgattcagacacttcttggtgtaggttcgcttgcctggtttttgttttttcttattagagaaatttatttgaataataggcgaacgcaacgaacaaggtttcaagttcgtctctctcatggcttgattgttttgggattacttttattcaatacaagcgttcatcaaactgttatttctacttttggacagactgacatgattcaattttggggtgagcatgaagctgcaattcacatgaatggtagagcataccacttgatatggacaaagaggtcatttcatagcaccacgtatttttataacttgtatgagcgacgaggactgttcttttaccgcgttaattctgaagtcatgtcgtggacaatcaatccccctgagcaaagagattatggtgcagttaggacatttctttatcacggtgaagagcaaggagtaaaatagtgtcatgcacacatacccaaggcacggctgctatcgcctttaagtagctgcctaattcgaacctatttgcaaacgaggagtctaaatgaatgaacaagcgaatttcgccaccaaagttctaacccttcatcaacgactggcaagcgtcaaaatgacgttacctggttgctatcagttggtgaatccatatagcggaaagcagaagcatgcagttgaccagatcacggcagctttttatcataaatattttaatgataatcacaaacggcgattaatcttggggagctcgcccgcgcgaaaaggcactgccataacaggagttccctttgaagatgcagccgagttacaagcagagacaggtatcgctgtggcgaagttccagattaagccatcgtcaacaaacttcttatatgatgtaatgcagcaatatggtggcaagagaaaattttatagtgacttctacatgagctttgcttgtcctttggggttaagtaaaataagtgctaaaggaaacgtgataaatagtaattattatgaaactaacgtgattaaggatagactaatgccattcatagttgcttcattgcaggagcaaatcaaattaggcgtagacacctcagtttgttactgtattggtagtggcgagaattttaaggtgctaacaagtatcaatcagacgtatcatttctttggtagcattgtcccattagagcacccgcgctatgtcatgcagtatcactttaaggacagagcccgctatattcaaaaatacgttgctgccttaaattgtaaataaaaggagtttgaaatattttggcaattcaatggttccccggtcatatggccaaggcccgtaagcaagtacaggaaaaaattaaacaagttgatctgattcttgaagtcgttgatgctcgaacgcctgaatcgtcacgtaatccgatgctagatgaattggtgggtgataaaccgcggcttatcattttaaacaagcaggacttggctgatcctgtactgacgaatgaatgggttcggtattatcaaacacaaggctttgctgcaattgcgattgatgcacaacatgctaagcggctacagcagatcccccaagcggccgcgaagttaatggcggaaaagatagcgcggaaaaaagcccgcggaattcgcaatcccatgattaaggcaatgtgtattggtattcctaacgttgggaaatcaacggttttgaatcggttggttcgaaaaaatatcgcggtgaccggcaacaagcccggggtaaccaagaatcaacaatggctaaaagcgagcgacaactttcaattacttgatacgcccggaattctttggccaaagtttgcctcccagacaatcgggatgcgcttggcattcacgggagcaattgccgacgccgttttccaggaggatgtggttggtttgtatggactgaactattttatggcgcattatccggcggcgttgaaaaaagcatatcatctgactgacacggatctgcaggctgcaccgcatgatgtattggtaaaactaacgaaaacgcaaggatttggtgaggaatttaatcggatggcggaacggctgattttcgatgcgcgccaaggaaagttaggtcgatttacgttagagaaaccgggtgaattagatgccgacgctgagtgagtataaaactcttttacaagctgatcatgttgatcccgcggttttaacggcgctagagcaggatagtcggattggggcgcggaaactcttggcggcttatcaacgccgacaggaccatcaagcagcagaagcggttgcgctacgatatcgtagcaggtatgagcgtaagttatggaaaatgtattcccatgttgcagggttagacgaagtagggcgcggaccacttgctggcccagttgtcaccgccgccgttatcttgccgcatcagtttaaatggccggtgaacgattctaagcagctgacagcgcatgaacgtgatgtcttgtatccgcatattttgacggaagccattgcggttggtatcggggtggcagataatcacgaaattgatcgggaaaatatttaccatgcgacggagctagcgatggcacaagcagtttcgcatttgcgggttgccccagagtttttactggttgacgccatgcatgtccccgttaatttgccgcaagaacggctcatcaaaggggatgccaatagtatcagcattgcggctgcaagtattgtcgccaaagtcattcgggatcgcttaatggtgatgtatgatcgggtttacccgggctatgattttaaagacaacatgggttatggtacgaaagcacatttagccggattagctactcatggcgtgacgccgattcaccggcgcagttttggaccggtacgacattgtctgaaatcctagatgtttcttaaaatattcgcgtaatgttcaagtaggaggaagacagcatgacattacgtgattttttattagcatggcacttggccacccatcagaatccgcgcttggcagttagtttacagcaagccattttgaaaaaagctgatctaagtacctatcaaaatgacctcaaacagaaattaacgccagcagttgcacggatattaagtgcagcacgcgagaccccgtatctgacgtttgttgatactgcctatcctccgcgcctgcgcgaaatcccgcagccaccgtctgtcctcttttatcaaggcaatctcggcttaatcaatcaattaactttaggggtcgtcggttcgcggaaggcaaccaactattcagctgaagcactgacgcgactgtttccgcaattaccgcctatgacaattgttagtgggttagccgctggtgctgacagtatggcgcatgaagcggcacttgcagccggactaccgacgattgccgtgattgctaacggcatcgatcaagtgtatccggctaagaatcgcagcttacagcgacaaattagtcgggtgggattggttgtaagcgaatatcctccgggaacagcaccgcaacgctttcaatttgtggcgcgtaatcgcatcattgccggtttagcgcatggcgtcatggtaaccgaagccgaaattaaaagcggcagtctgattacggctaactatgccttgcaacataatcgcgaagtttttgcgctgcccaatcggtttggcgatgtgctaggtgcaggcaccaacgcattaattcaagcaggggccgccattgtcaccggtccggaaaccttaatggaaaatctgcatttttacccgtaaagtgtcaaaatctgcttactttatagtagaaaaattttcgtttgatttgacaagagcaaaatgactagcttatgatagcaactgttttgagccagcaggcaagatggcacccgttttaagcagcgagacgcaccgtaaattttttgcctagctgaaactcatgaagcgttgacggtgaatcgtcagcctgcacaaattaaacagggcttgcttattgtagcaatgccaccggaaggagcgcgttcatggccgacaagaagttagtcattgttgaatcgccagccaaagccaagaccattgagaagtatcttggtcgcacctataaagttgttgccagtttaggccatatccgtgatttacctaagagtcagatgggcgtcgatgttgaaaataactacaaacccaagtacatctcgattcggggtaaaggcgatgtgattaaatctttaaaaaaagacgcaaaaaaagccagccgcgtttatctcgccgccgatccggatcgtgaaggagaagcaattgcctggcatgtcagtcatatcttagggcttgatccgaatgccaagaatcgggttgtttttaacgaaatcaccaaagatgccgtaaaaaatgcatttaaaacccctcgtggtattgatatggatcttgtcgatgcgcaacaagcacgccgaattctcgatcggctcgtggggtactcgatcagcccgctgttgtggaagaaggtcaaaaagggcctgagtgccggtcgggttcaaagtgttgcgttaaagctcatcattgaccgtgaaaatgaaatcaagaactttattcctgaagaatattggtccttggatgccgaattccaaaaaggccgcagcaagaaattctccgccagtttttatggcatcaaaaacaagaaaatggcgctgaagaacaatgaggcggttcaaaaagtcttaagtcagattgacaagacgaagccgttttccgttaccaatgtggttaaaaaagaacgcaaacgtttccctgcaccgccatttaccaccagtaccttgcaacaggaagccaaccgtaagctaggattccgcactcgtaagaccatgatgttagcccagcagctctatgaagggattaacttaggcggcaagttgggtacggttgggctcattacgtatatgcgtactgattcaacccgggtttccaacgttgccaaaaccgaaacgagtcattatttgcatgaaaaatatggcgaggcttatgccgctgtcaaaattcgccaaggtaagcttcaagaaggggctcaggatgcccacgaagccatccggccgacgagtacgttacgaacaccggaaagcttggcgtcggttttagacaaagatcagatgaaactgtaccgtttgatctggagtcgctttgttgctagcgaaatgacgccggcgattattgacacagtcgccgtcacgctcaatcaaaatgacgtgacgttccgggcaaatggcagccaaatgaagtttgaaggctttaccaagctatacgtttcctcgcgtgatagcgatgaaaaggataacgttttaccaccgcttgcagtcggcgatgctgtgaagatgctgaaaaccgatccggcgcaacactttacccaaccaccggcacgttattctgaagccaacttggttaaggctctggaagaaaacggggttggccgcccatcgacgtatgcaccgaccatcgaaaccattcagaagcgctattacgtcaaactcaacgcccgccgctttgagcccacggaattaggcgaaatcgtcaatagtttgatcgttgaatttttcccggacatcgtcaatatcaagtttacggcgaatatcgaatccgaacttgacagtatcgaaaccggcgaagccaattgggtcaaagtcatcgaccaattctataagccgtttgaaaaagaagttgcgcacgccgagaccgggattgaaaaaatccaaatcaaggatgaaccggccggctttaactgcgatatctgtggcgcgccaatggtgatcaaaatgggacgttatggcaaattctacgcctgctcccgattccctgactgccgtaacaccaaagcgatcgtcaaagaaatcggcgttatttgtcctaagtgtcacaaagggcaggttgtggaacgcaagagcaagcgtaaccgcgtcttttatggctgctctcgttaccctgactgtgactttgtttcctgggataaaccggtcggccgcgactgcccggtttgcggacatttcttagtcgaaaagaaatctaaagccggcacccaagtcgtctgtcccaacaacgattacaaagaagccttacaaaaagcataaatcacctgacagcaagtacggatcctttgtacctgctgtttttttcgggtacactaaggcaaagtgcgagcagaatcgcttaaaaataaccaaacacaaccaagataaacgtcttaagatcagtgatccattcaatcaaattaataacctcaccaaggaggaattcatgatgcctactgttaacgttattggagccgggcttgccggttcagaagctgcctggcaaattgcccaagccggcgtcgatgttaatctctacgaaatgcgccccgtgaagatgacgccggcacatcacaccggtaattttgccgaactcgtctgtacgaactcactgcgcgctaatcaaattactaatgcggtcggacttttaaaagaagaaatgcggcggctgcattccattatcatgcaaagtgccgatgcaaccgcggttcctgccggtggtgcgctagccgtggatcgcgagccgttttccgagctggtgacccggcagctgacaaaccatccccatattcatgtcattcatgacgtattaaccgattttccggctggcataaccgttgtagcgaccgggccattgacagcgccgggacttgccgatgcgattgttgcgttgaatggcgaagcaggcttgtccttctttgatgctgcggcgccgattatcgacgccagcacgattgataacgacatcgtttataaaaaatcgcgttatgaccggggtgaggctgcttatttgaattgcccgatgaataaggaagaatttcaggcattttacaaggcgctggtgacagctgaggttgctgaaggtcacgattttgaaaagatgacggtgtttgaaggttgcatgccaattgaggtaatggccaagcgcgggatcaaaaccatgctatttggtccgctgaaaccggttggcctggaagatcccaaaaccggcaagacgccatatgcggtggtgcagttgcgtcaggataatgctgcagccagtctttataacattgttggttttcaaacgcaccttaaatggggtgagcaaaagcgggttttccgcatgattccgggtctggaacatgctcagatcgtccgttatggcgtcatgcatcgcaatacatttatgaaatcgccagtggttcttgagccgacttatgcgtccaaacgccgcggtgatctcttctttgccgggcaaatgaccggggttgaaggttacgttgaaagcgcggctagtggcctgattgccggtaccaatgcggcgcgtctggctttggggcaaacgcccatcgcttttccgcaaacaactgcgatgggggctatggcacactatattacccacacctcgccaagtcactttcagccgatgaatgctaattttggtattatgccgccgttagcagtcaaggttcggaataaaaaagaacggaatcaacaactcgcagagcgcgcattgaatgatctggcaacttttcaaactgaattacaaggcgcacatcagtcctaaaattggaaaatgatctcgggtaaccgggattttttcatgatcacgggtcgtcatgttcgccaagtactcaatgagcgaataatggtggcggattgcagtttttttagcccgtcttcgcctatatttacggcaggtttagtggctgaaaacgtcaacaatcgttctttttatgttaatctattaagcggagggatgtcgtgatgaagccacttgcagcgtttcaggaatacttaaccgttgagcgccagtattcgccggaaacggttacggcctatttaaacgacattcaggaattccaggcttttcttaaggcgaatggtgggtttaccgactttagcaaagtggacgacttggacgttcaaacctatttaacggacttgaacaagcaggcgttggcgcgaacttccattgcccgtaaaatcagtagtttacggagcttttatcggtatcttgttcggattgatgttgtgaaacgcaacccgtttgaattggttgagttaaaaaagcagcatcatcatttgccgcagtttttctatgaggcggaaatacaggaactctttaaaacggtagaaggaaaaaccccgttggatcaacgtaatcgggcattactcgaggttttgtacggtaccggcattcgtgtctccgagtgtgctaacttgacgttgaatcaagtggattttaataccggcttattgctgattcacgggaaaggcaacaaggatcgctatgtgccgtttggccgctatgcccagcgtgcgttgcagacctatctcaaagacggtcgccagacactgatgaacaagcgcgatgtccagcatcgatttgtgttcgtcaaccagtatggtcgaccgattactgcacgtggtattgaatatattttggatcaattaatcaagcaaacgagtctgatcgcgaatattcatccccacatgctccgccatagctttgccacgcatatgctggatcacggggctgacttgcgcacggttcaggagttactggggcacgcgagcttgtcaacgacgcagatctatacccacgtgacgatggcgcatttgaaaaacgaatatatgaaatattatccgaagcataattaagactaaagcatgatgtaattgcacgatgaattttttaaagtatgaacattggcagatttaacaacactgccagttctgattgattatccgatatcaagaaacaaaaaaggagcataccatgacaacaattgcagcagtgagaaaagatggcgtgaccgctttagccggcgatggccaagttactttgggcgaaaaagtgatcatgaaaggcaatgcccaaaaggtacgccgaatctatcatgatcaggtcgttatcggttttgccggcggggtcgccgatgcgtttacgcttcaagactggtttgaaaagaaactagagcattattccggtaacttacgacgttcagcagttgccttggctcaagactggcgtaaagatccaaccttgcaaaaactcgaggccatgatgatcgtcatggatgagcatgatttgctgcttgtttcagggtctggagaagtcattgacccagacgaggacgtggtggcgattgggtcgggcggtaattttgcccaagcggccgcaattgcaatgttgcggcattcaccagacatgacgccggctgatattgctaaagaagcggttaatatcgctggtaatattgacatctttacaaatcataatattatcgttgagagtttctagggcgttcgttggtgcagaggtctggatgtaaaggcttattgcgtgctggctcacgctccgtaacgcgttcaccggcgcagaagtctgcgtgtaaggcccttaggcgcaatggccaaagcccggccatcacgcctaaggccacttacactccgacttctaagcgcgtcggttcacgctcactttcttttaggaggttcccatggtagaagtacaaacaccgaagcaaattgtagaaaagcttgatcagtatgtgattggtcaagatgaggcgaagcgggccgtggcggtggctttgtataatcgctatcggcggatgcagttgtcgccgaagatgcaagaagaaatcacgcctaagaacttgctcatgatcgggccaaccggggtcgggaagactgagattgcgcgccgcttagccaagatcgtggaagcaccgtttgttaaagttgaagcgactaaattcactgaagtcggctatgttggccgtgacgttgaatcgatggtgcgcgatcttgccgaaacggcggttgccatggaggaagaaaagcagtttaaaaaagtccgggttcgcgcggaaaaagaagctaacaagcggctggttaagattttggtaccggctattcgcaaagaaaaaaatagcaatccgatggcggaaatgatgagtatgttgcaaggcatgcaaaatggcaagatgcccgcgggtgacgatgctgatgctggcggtgaagtgacggatgacattcgcaatcgccgtttaagcgtggcggagcaattggaaaaaggcttgttagaggatcgtgaaatcaccgttgccgtcaatgacgagaaaaaaggcggcggcatgagtgatatgtacggccaaatgggcattgaccttagtgacacgattggcgctttaatgccgaagaaaaaagttgaacgcacgatgaccgtcaaagaagcacgcgaaatcttcattaaagaagagtctgataaactggtcaatcatgccgatatttatcatgatgcgattcaaagcgcggaaaataacggcatcattttcatcgacgaaattgataaaattgcagccggtgataaacacacgagcggtgaagtttcccgtgaaggcgtgcagcgcgatattttgccgattgttgaaggctcacagattaacaccaaatacggaccgattaatacggatcacattctgtttattggctcgggcgcgtttgcagaagccaagccaagcgatttgattgctgagttgcaaggacgttttccaattcgcgttgagttaaaagatttaacggaacaagatttcgtgcggatcttgaccgagccggacaatgcgttgattaaacaatacattgccttaattggcgcagacggggtcaaaatcacgtttacgaaagaggccgttgaacgtatcgcagaaatcgccactcaggtcaaccatgataccgataatatcggtgcccggcgactggcaacgattctcgaaaaactgttggaagatgtgctttatgaaggtccggatatggcgatgggcagcgtcacggttacccagcagtatgttgacgacaagattgggcatatcgccgcggatagcaacatgacgcgctatattttgtaaggtaactttgaagaactgttaggtaaaggatgagaatgtatggtaacgattgcaaatgactttttaacggttaacatcagtcggcatggtgctgaattgaccagtattaaggataatctgactggccgtgagcgactatggcaggctgatcctgaagtttggccacgccatgcgccggttttatttccgattgtcggtgcattggctgatcagcaatatcattacgctggcaagacttaccatatggggcaacacggatttgcgcgtgatcgtgactttacggttgtgtccgcaacgccttttaaagccagtctcgtgctcaaagatgatgacaaaacgcgggcgatgtttccgtttgcttttcggctcatcattacctatgcgctagaaaataataacctgcacgtcacctaccacgtcgataaccccgctaaaacggaaccgttatacttcagcatcggtggacacccgggttttaacgttcccatgacgccggataccgaatttgcggactattacatgaacttcaagccgcgtaagtctctggtgcagattccgcttgtcgctgggcaaggtattgattacagtcatcgaactttggctgcgaccgatgccaacctagcgctgacacacgaaacgtttaaaaatgatgcgcttatttttgcgccgcttggtaaaaccaccttcaatttactttctgatgaaaccaagcacggagtcagtgtgaccatggaagacgccccttaccttggtgtttggagtccataccctaagaccggcgattttgtctgcatcgaaccgtggtggggcattgcggatacgatcggcaccaccggagatctgaccaagaaactcggcatcaaccgtttggaaccgggaacggcttttgagaaaggttacacgattagcattttctaactgattaacgaagcttgttgtgccattacaaaaagacatccgctaggggatgtctttttgattgtcaggtatttgggtgattattcatgatgacgctgattgcgcaggtataggccgagcccaaacggtaccatattttcgtcaccggccttgatgcgtttgaaattggcgcgatgtttgatgaaaaagacaaccagtaagccgcaagcaactgtcgtcagtagccaatcgtgatacaccaatgaccagcacgtgataatcaccatccccagcgtactggccacactcaccatggacgttaataagatcaggctaaaccagatggcaaaggcgatgaagaaaaatggcgggttatacgctaacaaaataccggcactggttgcgacagcctttccgcctttgaaaccaatgtagatcgaaaaagtatgccccaataccgctgccaacccgacaaccaagattagccagtggtggtcaatcccaaataaaatcggtaaactggcagacagtgttccttttagaatatccaatagcaagactagggtaccgccgaccggtcctaacatccggtaagcattggtggttccgatattatggctgccaccttggcgaatatccgtatgataaaatagtttgccaacgaccaccccaaacggaatggcgccgatgaaataggcaagtataaaacaaagcacaagtaccaaatgtgcccctcctctcagactaaaaactattttagcatttttgacttttgagggatacgccggtaaaataatacgaacacacattcgatctgtgaactatattgcatcttgacagcttcatacaggcgtttttgactgtgatattttgccggtgatcacagaaattgggttttcttaaacgttcctgcgctcgccctccgcttctgcgtggtgtattctataaattagttgtttcaaaaagggagtttattatggacaaagcaacgcaagcatataatgattcatccattcaggtgctacacggattagaagccgttcgtaagcgtcccgggatgtatattggttccaccgatagccgcgggttacatcatttggtttatgaaatcgtggataactcagtcgatgaagcgctcgcggggtttggggatgaaattaatgtcacgattcacgccgataattctgtgactgtgcaagatcatggtcgagggatgccaacgggaatgcatcctagtggtaagccgaccatcgaagtcatcttaacggtgttgcacgctgggggtaagtttaaccagaatagttataaaacatcaggcggccttcacggtgtcggctcaagtgtcgtcaatgcgctgtctgagtcattgacggttcgggttgtccgggacaaacacgcctttgaagagcattttattaatggcggacatcctgatggcgggttgcagaagttgggcaaggttaacgaacccaacggcacgaccatcacgttcaagccggatccgactgttttccagaccacggttttcaattacgataccttagccgaacgactgcgcgaatccgcgtttttgttgaaggcgatcaccattaatttaaccgatgagcggaccggtaagcatgatcagtatcattatcctgatggtttggttagtttcgtgaaataccttaatgaaggtaaagacgccttatcgcaagtcattaattttgaaggcaagaaggacggcattgtcgttgattttgccggtcaatacaatgatggctactctgaaaacattatttcgttcgtcaacaatgttcggactggcgatggcggcacgcatgaaatcggattgcgcagcgggatgacgcgtgcttttaatgaattcgcccgaaaagtcgggttattgaaagaccgcgataagaatcttgaaggcagcgatgtccgcgaaggttttgcgggtattttgagtgtccgcatcccggaagagatcttacagtttgaaggccagaccaaaggcaagttggggacgcctcaggcacggaccgttgtcgatgggattgtgtacgaccaccttgccaccttcttgatggaaaacggtgaagaatcgcaagaactcgtgcgcaaagccattaaagcccgcgatgcccgtgaagccgcccgcaaagcccgtgatgacagtcggaccgggcgcaaacgcaaaaaggatcaggggctgctttccggtaaactgaccccggcacagaccaaaaaccctaaacgcaacgaactgtatcttgtcgaaggggattccgccggtggttctgccaagcagggacgcgatcgtaagttccaggcaattttgccattacgcgggaaagttttgaatacgcaaaaagccaagttgcaggatatcgtcaaaaacgaagaaatcaataccatgatttataccattggcgccggtgtcggagccgattttgacatccagcaggctaactacaataagatcattattatgaccgatgccgatactgatggtgcgcacattcagatcctgctgttgaccttcttttaccgatacatgcggccgttaatcgatgccgggcgtgtgtatatcgcactgccgccgttgtaccgcttgcaaaaaggtgctggcgctaaaacgaagatcagctatgcgtggacggatgaagagttagctaaggaaaccaaggcgatgggcaaaggctataccttgacccgctttaaagggcttggcgaaatgaacgccgatcaactatgggagaccacgatgaatcccgaaacgcggacgctgattcgggttcggattgacgatgcgcagctggcagaacgccgggtcacgacattgatgggcgatcgggttgaaccgcgacgtgaatggattgaacatcacgtgaagtttgatctggatgatgaaggcagtatcttggaaactccaacggcaaaccatgaaaagttgcaattcggagctaagcaaatcgttaagcaattagataagaaaaggaagtaaaagccattggccaatcagattcaagagttgaccttagaagaggtcatgggcgaccggtttggccggtactcgaaatatattattcaagaacgcgcactgccagatgttcgtgacgggttaaaaccggtccaacggcgcattttatttgcgatgaaccaagacggcaacacctatgacaaaggatttcgtaagtcggctaaaagtgtcggtaatgtcatgggtaattaccatcctcatggcgacagctcgatttacgaagcgatggtgcggcttagccaagactggaaactacgcgcaccgttaattcagatgcacggtaacaatgggtcaatggacggggatccgccagcagcgatgcgttatacagaagcgcggctaagcaagatcagtaaggaaatgttggcggatattgataaagaaaccgttgatatggttttaaactttgatgacactgcccaggaaccgactgtgctgccagcgggttttcctaatctactcgtcaacggtgctactgggatctctgcagggtatgccactgaaattccgccacataatttgcgggaagtgttcaatgccattttgtatctgctaaaacatccgcaagctgatttagccgacttgatgcagtatgttaagggacccgattttccaaccggcggcatcatccaagggcttgacgggatcaagcaggcatacgaaaccggccggggaaagattgtcgttcgctcacgcacccacattgaaaccattcgcggcggccgcgagaagattgtggtcactgaaattccgtatgatgtcaacaaggcccaaatgatcaaaaaaatcgatgaactacgacttaacaaaaaagtcgacggtatcgctgaagttcgcgatgaaagtgatcgattcggcttaagtgttgtcattgagctgaaaaaagaagcggatgcccatggaattttgaattacctcttcaaaaataccgatctgcaaatcacatataactttaatatggttgcgattgccgatatgcaaccgaaattgcttgggctcaaggcgatgttggaagcttatgtggcgcatcgccgtgatgtggtcacacgccggacacgttatgagttaaacaaagcgcaggcacggcagcacattgttgaaggcttgattaaaatgttgtccattttggatcaggtcattgcggcgattcgtgcatcctcagataaaggggatgccaaacgcaatttggtcaaacaatttgatttttccgaagcgcaggctgaagccattgtttctttgcagttatatcggttgacgaataccgacattaccgctttgcaggacgaggcggcacaactggccaaggcgattgccgaatatcaagacattctagcgcagccggcttcgcgtgatcgggtgattgaaaaagaacttaaacggattgctaaagagtacggggatgatcggcgcagcagtattcaagccgagattgaaacgctcgaagtggcaacgacggtcacagtggctgatgaaaccgtgatggtccaggtgtcacgcgacggctatgtcaaacgcagctccttgcgtagttaccaagctgttgatcctgaagataacggtttaaaacccaatgatttggcgatttttaccggagagttaagcaccctgcaacatctttacatcgtcacgaatgccggtaatatcatttatcggcccgtttacgaaattagcgatgcgcggtggaaggacactggggaacatttaagccagacagttggcttgggaaccgatgaaaaggttttggcggtctttgcttttgatcagctagatcttgctggtacctttgtccttggctccagtgacggctacattaagcagacggcattgagtgatttgcagccgcagcgcacgtataaacgcaaaccaatgatggcaatgaaactgaaaacaccgggtgccgtggttaccaacgcttacttcacgaccgatcaagcccaggatgtttttgttgtcagccgacatgcgtatggactcgacttcccactggatgaagtttccacggtcggtgcccgggctactggggtcaaaagtatggatctcaaaccggaagatgaggtggttaactttatcttagttaagcagccagaaaaagcagtggtgggcattttgactcagcgtggtgcgtttaaacgtatggcgttaagcgaagtcggtcaaatgagccgtgctcgccgcggattgcttgttttacgcgaattaaagcgtgatccgcaccgcattgtcgccatgatgcaagtcgatgacaacacgcgtctggacgtgttaaccgatgccgataaagtgatcacgttaacgcctgtgaaccacccgacaggtgatcgctactctaatggttcctttgtgattgatactgatgtccaaggaaaaccggttttcgtacgcacacgtgaagaaacaccggttgaaccgtaacacaaaaaattctccatctgtattaatacagatggagaattttttatttattatatgacagtacggttgtgcacaacttatcaagctaatgattaagctttttttatgaaacaggaaagtacaccgaaaaaaacagcaaaacgcctgttatatcagcgataaaacgcttgcatagatttgccttcgtgttatactgagtttgtaagaactgtcacatctgtaattcactttaggaggcaatacctatgaaacagcttgacgaaaccaaagttcctaattattgggaaggctttaacggcggcgactggcaagaagaaattaacgtgcgcgattttatcgagcataacctgaaccaatatgatggggacgagagtttccttgctggccccactgaagcaacgactgttttaaataatcaggttttgaatctgaaaaagcaagaacgtgccaatggcggtgtactggatgcagataacaatattccatcgaccattacttctcatggccccggttatctgaataaggacctcgaaaagattgtcggtgtccaaaccgataagccgtttaagcgagcattcatgccatttggcggtatccggatggctgaggatgctttgaaatcctatggcttcgaaaccgacgctaatgagcacaagatctttaccgaatatcgtaagacgcataaccaaggtgtttttgatgcttatacgccggaaatgcgcaaagcccgccactataagattgtgaccggcttaccggatgcttatggtcgtggtcggatcgtttcggacttccctcgaattgctatttatgggattgaccggctgatggctgagaagttcaacgattacaacctgaccggcgatggcgagatgacagatgatgttatcaaactgcgcgaagaaattaatgaacagtatcgtgccttgaatgacatgaagaagatggccaaagaatacggctatgacatttcccgcccagctgctaatgctcaagaagctgttcagtggatctacttcggttacctggcagccgttaagacccaaaatggtgcggcaatgtctgtcggccgtatcgatacagtgattgatgcctatattcaacgggatatgcgtttgggcaagctgaatgaagagcaggcacaagaactcatcgatcatttggttatgaagttacggatggtacgtttcattcggactgaagaatacaactcactgttctccggtgatccgatctgggcaacactgtccttggcagggatgggtaatgatggccgtcatcatgttaccaagaccgcgttccgcttcctgaagaccttggacaacatgggcgcggcaccggaaccaaacatcaccttgttgtggagcgaacgtcttcctgaagggttcaaacgttatgctactgaagtgtccatccaaagttcaaccattcagtacgaaaacgatgatctgatgcgcaacgaatggggaaccgactattacggcattgcttgctgtgtttccgcacagccaattgcagatggtgttcagtacttcggggcgcgagcaaacctagccaagaccgtgctgtatgcgatcaacggtggtaaggacgaaattcaggaagcacaggtgggacctgaatacgagccgatcaccagcgactacattgactatgacgagttcatgaagaagttcgacaagatgatggactggttagcagatgtctatgtcaatgccctgaatgttattcactacatgcacgacaagtactactatgaagctgcgcagttggcattgaaggatacacgtctgaatcggacgtttgctaccgggatttccggtttgtcacatgcggttgattccatcagtgccatcaagtatggccacgtgaaggcaattcgggatgaaaatggcgttgcaatcgactttgttgctgacaatgatgactatccgcgttatggtaacaatgatgaccgggcagacaacattgctaagtggttggttaagaccttctacaacaagatgaatacacatcatctgtatcgcggtgctaagctcagtaccagtgttctgaccattacatcaaatgtggtttatggtaagaataccgggacaacaccaaacggccgtcagaagggcgaaccattctcacctggagccaacccagcgtatggcgctgaaaagaacggtgctttagcttccttgatgtcaaccgccaagatcccatatcactatgcaacagacgggatcagcaatacctttggggtaacaccgaacaccttaggccatgacgatgaaactcgtaaggacaccttggttcacatggttgacggctacatggaaaatagcggcatgcaccttaacatcaacgtcttcaataaagaaacgttgattgatgcccagaagcacccagaagaatatccaactttgactgttcgagtttccggttactgcgtctactttgcagacctgaccaaagaacagcaagacgatgttatcgctcggaccttcttcgacgaaatgtaatcaagtcaatctattcgcaaaacaggagatcattcctgttttgtcaaaaaacggcaacgatgctgttgccgttttttgacaaactgaaatgaaaatcgttgaaaattaggtatttatttgcactggaggcggcatagatgaaactcatcgatcaatcacaaagcccgttaaatattttggaacaagtgggacaggatcatgaaggcccaataaagggatacgttcattcagtcgaaagctttggttcggttgatggtcccgggattcggtttgtcgtctttatgcaaggatgcaggatgcggtgccagtactgtcacaaccctgacacttggaatatcggtgtgggcgaggaaatgaccgctgatcagatcctggcagatgcacagcgatataaagccttctggggtgaacaaggggggattacttgtagcggtggcgaaagtctcgtccaaattgattttatcctggaactttttaccaaagctaaggaactgggtatctcaacttgtttggatacttcgggtggtccattcacccgcgatcagccgtggtttggtcaatttgagaaactgatggccgtcacggatatttcgttggttgatatcaagcacattgattccgcggaacacaaaaagctgaccggtttcccaaacgaaaacattttggatatggttcagtatatgtcggatcatggcgatgatatgtggattcgccacgtacttgtgccagaacgaaccgactttgatccttatctcaaacgcttgggagattatattgccactttggataaacgcgtggtccagaaagtggaaattcttccgtaccatacgttaggggttaagaagtaccatgaactaggtattacgtatccgctggaaggtatcgagccgccttcagctgatcgggtcaagaatgcagagaacttgctacacgttgaggactatactggatggcaaagttggcgaccacagccagctaacaagcagtgatttagttgaaacttaacgtaacgattaaaaacgcagcaaatccgttgcgttttttttaaatgccacttatgatgatggttgagtaacgttatcaaattataaacgaaagggaagccgccctatgaagacgaaacaagagcgcattttttcctccaaaactctcacgtattttttgcaattagcagaaaccatgaactacacccagtcagcccagttgttggggattacccagccggcactgacgcagcaaatcaagaaattggaacgaacagtgggggcaccattgttttattccgttggtaagaagttgcatttatccgatgccggtcgcacgatgttgaaggcgacacacgagatttatgaaattttgaaccagacgactgacgagattcagcaaagtaccagtgccacagtcggtaagattaatattggcttgttaagttcaattgaagacagtgcgtttaatgcttttatcgcgcactactatgatcttaatcctgaagtagaaatcacgttgcgaatgatgacacgtcatgagatctgggaagcattggagaacaaccagattgatttggccatcatgaatctgcctgatgagacgattaagaactggaaaccgtatgccagcaagaagattcttgatgaacagttattgttcctgcaccatgataattccctggctaatcgcaaacgcctgcatttcaaagatacgctggctgagccgtgggtaacttatccagacgactatttcctgggtcagttgttgcatgaggcatataagaatcagatggttgattttccgcatgttgtggcgcattttaccacgccatatcagttaactcagtttgtcaaccataccggtgttaacaccgcgttaccaaccagttttgttgccgctcatgctgatcaaatcaaggcgcatgccgttgcctttgaaccagcgattcgctttgagacctcgtttgtgtatcgcaaggaaaaagctgatattccgcggattgccaacttctttaagacgtttgacgcacatttatctgagaaagattatctatcgcgggtcagcgaaaacagtggtaaaattgaaaggtaaactattcagctgaggagcgatcagataacatgacgactttgatttttggacatcaaaaccctgatacagacgcgattacaagcgccatgagttgggctgaatttcagaagcaagcaggtaataccgatgttgaagcagtagcactcggtgaaccaaacgatgaaaccaagtttgtattggatcattttaaggttgctgcgccgcgggtcattaagacagccgcaaatgaaaccgggcacgtaatgttggttgatcataacgaattccagcaaagcgttgctgatatcgaagacgtgcaaatcgattcagtggttgatcaccaccgcattgccaacttccatacggcgtcaccactatattaccgggcagaaccagtgggcagtaccaacacggtgattttcgagttgttccaggaacacggctatgaaatttcaccaacactggcaggcttaatggcttctggcttgatttcggataccctgcttctgaagtcaccgactgcaaccgacaaggacaaaaagatcttgccggaaatggctaaaatcgctggcattgacctgcaatcatacggtttggctatgttgaaggcgggcaccaatctagctgccaagtcggatatggatatcattgaaggcgatgcgaagagctttacgatgggcggtaagtctatccgtattggacaagtgaatacagttgatcttgatgatatttatgcgcgtcaggatgaattggtggccgctatgaccaaagaagcacaggcgaagggctatgatgacttcctgttaattgcaaccgatattctgaacagcaattcaacgggctttgctgttggcgcagatcgtgacaaagtggccgcagcattcaacgaaaagtttgatgccaatgaccggttggcactgcctggcgtggtttcacgtaagaagcaggtcgtaccgccaatgcaaggtgcgtttgaaggttaattttgaacttaataattggttttataaatcgcagccgtttgtggttgcgatttttttgtgctcaaaaacttggaagaacaaaaaagtcgaatttttagatctgaaggtgcagaaatgtgattattgcgaaatttttcagtaagaatagttcaaatttaaaacgaggtgcaaaaaacgcagccttataactacttcgtataatatatattatgtaaactagaatggagattttgagtcgttgactttgacgtgacttatttggtgttcaaatggcaaaacgattgatgcaagtcccctcacctgacagacagctcaaaaacttttgagagaagcaaatcaattgtacggatgtgagcggtgcgctttatttgtttttttctggtttgaaaatgaccagtcgttgctaaatatatgtaaattcagcattaatcaaagcagatttgtagaaagtatcattttgagtcataaacagcattcaagtcgcaagtgttgctgtcagctgaattctggatcaaaatacgaaaattgatttgattgcagccaatgaatcgttggttaattggttaaactgttgctaaagcggcgccgtggaatcaggacatcagcacagatgtcctgatcgtgcagtgaattcaaatttgaaatgcaactaagtttagtgtcaaatgacagatcaacaaatttggtgatttagctggcttgatgattagaagcccatttacctttggataatactaaaactttattcagttctacactggtgcttttttcggcgcatatcgttgcgaattaccgatattttcgtcattatccctcgccacgcactggttttttcgcgtatactgaaattatccaaaagaaaacatatgttcgaggtgactttatttgtcgacacagaactaccctaaattaatacaagccatgctaccttccctgccggactatattcaggattactatcacagccaaaaagcaattcccatcgcggattctaccctttaccagtacctgcacttttaccaggaatttctgcattggcttatttccagtcgggtcacggatgccgtttcgccacagaatgtgcctttgaagaccttagagcggctttccttgcgtgatgcgcaggcgtttgtggcgtatttacttgagcggccgtcgaaaacccatccgaataaacgcatgacgcggcgcagtgttgcgttacgactggtcgggatcaaggccctttatcggttcttaaccgaagaaagcgaaccaaatgcagacggtgagccttatttttaccgcaatgtttggaataaggtgaaacttaagacccatgcggagacgacgacttaccgtaatcataaactgcaggaaatgttgtttgtagatggcgaagatgcgcgctttttacagtggctggatcggcaatatgctcagcagctgccatcgaaaccgcgcgcttattttgaggcgacgaaggaacgaaatttggcgattattgcgctgctgtttggctccggcgtgcgggttagtgaattggtcaatatgaatttggaagatctcaatatggatcgtcatactgtgcaggtggtgcgtaaaggtaattttcaggatcgcgttaactttgctgactggattgatccttatttaacggcttatttgaagtcccaaaccgcgatgattgggcaccagaagcctacttctccgctatttgtgacgcaaatcggccaaacggtgaaccgcattcgccaaaatacgattgaagcattcttcaaacgctatacaaccgcttatggccgcccatcaacaccccataaagcacgccataccttgggaaccaatatttataccgtcaccaaggatgtgcagcaagttgccgatcaactcggacaaacgacgaccagcgctacggatctgtacatcaatctcagcgataaaagtggaaaagcggccttacgcgaagtttcggaaactgccgccaaagccgtggatcaacatccccagcaaccataatgtcggcggttagttgtctggttaagtcatgttgcggcgctaattaacgttacagtattcagtgagataacagtggcgacattttttgatgctggttgacatagaaaaaagctacctgatcgcctttgatgacttgcgatcaggcagcttttttatgctctgcatcaggccgccctcacccacggctggatggctgacggcgggaaacaattcgataataaacgttgccagtcaagcggtacatcagcacgtagatgaccgcaaaaattgcaagcgtgattaacgaaacggttaagaagaattgccaatccggcaggccgaatagcatcataatacgttggacaaagggcaatgcaaagcccacgtggatggcagcgacgatcaaaggcaggtaaaacagtgtgagtagctgactgttaatggtagcgcgaacttctcgaaggctcaggccgacgcgttgtaagatggtatagcggcgtgcatccgcgtagccttctgccaactgcttgtagtaaagaatcagcaaggttgccaggatgaaggtcaccccaaagacaaccccaaggaataggaaactgctcatcatgctggcagtatcatcgtaattagcggctcgcgactgaaccgattccggtaatgcaatcccacttttgacgactgcatgataaagtttgacctgattggcgtgactgccgcttaatgttacgtcttgattagtggtcacgtcggctttgagcagtgccattgacctttttggataaagcgcgtgtaaagcggttaatagttgtgcgtcagatggaagcgcgacaaacaagttaggaataaacgttttaggcgcatttggaaaactggtgacttgtttggcgacgtggtaagtctgtttgccaatacgcaacgtcgcgggttggtaatgattggaggcatagattaaaacctcatcatgattaagagccacatgtttgccagtatagcgattataattttcgacggtcatcagctgaaccgaacgggcattattgaagctaaacgggccgttaaagttagcttgagaatctaacttgtttttttctaataaagcaagcgtacttgagggtccggtaaaggttcgcatcgagtggattttgacgtgatgtgttttagccagggttcgtagttggttcgctgcatccggccgcttggggttgattgagtaagctaaatcaaccggagtttgcgagttgacaatctcatgaatgccaaagaatagcgttgccgtggttgcaagcgtaatcagcgtcatggtgactaaaatagcaatcgaagccaatcccgcgccgttttgctgcatccggtaaagcagatttgatacgttgataaaatgtttaggtttgtaatagtagttcttgcggtgacgcagccattttaaaacgaataccgagccggacgtgaagagaccgtaagtcccgactatgacaaggacgaccgcaaagaaaaacaaactcatcgcttgaagcggattcttgacggtgaccgcaatcgtataaccggcagccagactcgcaatgctgacaatcaaagttagccacttggttttaggttcccgttccccggcgttttgttcgcgtacgagttcgatgggatgtttacgcaatagccagaactcgtcaaccaacattaaaacaatgaacaagccaatcgtgatcaacccggcaatgctaaaggcggtttgactcaagccaaaatcgagattgtgattgacatgcagcattttggccaaagtgagatagctaaggcgtgacagcacggttcccaaaatcccgccgcacaataaggttgtcagcaacagcagcagcttttccgtagccatcattttgcttaattcacgtttgccaaagccgatgatgttgtagagccccaactggcggatacgctgtttacgcaaaaagttgttggcgtagatgattaagatgacggaaatgattgcggtcgtcatcgagccaaatgaaaacagtgatttgccagctgcctgcccgaactggcggaacaaaacatcactgctcgtgtaggcgtttagcatgatcaaattaatggccatcaaaaagctagtggtgatgacaaatggcacaaataaacggcgatcggctttaaggttggtggcggctaatttgaaatagaatttcattgcgcctcgccttccttcgtcagcattgcggtcatggtttcgctgattcgggtcaaaaattcgggctgctgtaattcaccgcgatacagctgatggaaaatctgaccatcgcgaataaacaaaacacgctggctatgactggccgcaaccgcactgtgcgtcaccatgaggattgtctgcttactttcggcattgacatcggttagcaggtccaacagctcactggaggttctagaatcaagtgcgccggtgggttcgtctgccaataggatttccggctcggtgatcattgcccgagcagcggctacacgttgttgttggccaccggaaagttcatatgggtattttttcagtaaatcggtgatacctagacgcggcgccagttgggtgagccgatttttcatgatttcaagcggcttcttggctaaaactaatggcaggaaaatgttgtcctgaacgttaaaggtgtcaagcaagtcaaaatcctgaaaaataaacccgagatgttcccgccgaaatttagcccgtgcgccttctttgactttgcgcaggtcctgtcctttaaggctgatttcgccaccggtaggatcatcaagcgtggcgattaagttcagtaaggtacttttgcctgaaccggattcccccataatcgcgacaaattctcctgattcaacggaaaaactgatgttcacgagtgcctgtaccggttgggcaccgcgactggtataagtcttttcgacattttttaactttaataatgttgacataagatccgcccctttcatttatcagcttaaaagggatattgccgaaaaactacttacagtcagcgtgcgttgcttacaagctggtaaggtggcttactcggctagccagcgcgtttgcgggaagtgaatggcaaaggtgctgccgacaccgacttttgatgaaacggtcaggtgtaaccctagcttttgggcaatttgccggcttaaaaacagacctaagccacttgccttttgattggcgcgaccgttgtatccggaatagccttgttcaaaaatccgcggtagatcttctggcaggatgccgataccggtgtcagccaccagcacggcatcgcccttggcataaatccggatgctcccatgcggggtatatttgatggcattggttagtaattgctcgaaaataaatcgcagccactgactatcactcaccacagttggcaaagtttctaccgtgaccgttaagtctttggcaataaacaatttcgctaaatcccgcacggtttcgttaacaagcggttttagtggtaattcggttaacaccaaatcggtattcagtgtggtcagtttgaggtaattcagcatcacggtcagataacggttgattttaccaacttcaagccgcgcatcgctggcattgacaggttcaacctgtaataagagatccagtgcagtcagcggtgttttaatttgatgggtccacagttgcaaggtatcgaccgtttcttgttcctgatcacgatacgtgtcatgattttgacgcaaggcctgttgcagcatttggattttttgaaaataaacctgcccaagcggatcggaaatttgatcagccgcaagcagtgtgacatcgccttggagctgtgaccattcacggcgaaatcgccaaaaatcgcagccgccgatcacaagtaacggaatcagtgcaaaaaaccagctgtttaacgcgacttcaagcgaggcgttaatcagccagtttgctaacagactggcaaccagtaagatgagtaaactcagccaaaccatccagcgggcgcgcaaaaaagctttaatcatggccgccctccttattcgccaaacggtagccttttcctttgacggtttcgatcagttggttgagtcctaccggggcgacttttttgcgtaaccgattcatgttcactgccaaggcgttgcggtcaatgaactcatcgccttcccataacttctcgatcatcgcttctcgggtgaccacttcaccatcggcaccaaataacaggcttaataacttggtctctgtcggggtgaggtcaatcacttgagtcggcgagcgtagttggttgtcggtcgggaccagcgtaaactcaccgtgatttaaattggtatcggtttgctggtattggtaggttcgccgcaacatcccctgaatcttcgccaataaaaccggtagctcgatcggcttagctaaaaagtcgtccgcaccgagattcatcgccatcaccagattcatatcatccccggaactggtcaggaagataaccgggaccttgctatgtttgcgcaattcgctcagccagtggaagccattaaaatacggtaggctaatatccataatcaccagatccggtgcggcggcgcgaatttcagcgtccacctgatcgaatttttggaccaattcaaccgtaaatgcccaccgattaaggtagttaccaattgtctttgcaatcacatcgtcgtcttcaacaataaaaatcttttgcggcatgtttgttatgctcccctcgtggtgattcgtgggctttttaagtcaattgctttaaactaaagtcagcttctattttaactgatttcaggtgttaaaagtgagacaagccaaaattgggtggcaggggcaaactgccgcctttctcttaagtcaaaatttatttgtttttggaacgtccaccgtcttttttgcggtgctctgggatattgcgctaaaaacctcttccggcgcgtggatgacctatgtttcgttagcaaccgccctgccagctattttaatttcgctttcagcaggcgtcttggcggatcgctacaatcgtaaatggctgattgtgatttctgcagtcggcgtcaccgttttgaccctcgcagtagcttatgtgtttgcgtttgtgacgcaggagctatggttgttactggtcatcgcggtgattcgcagtttggggaatggtctggagaatccggcggctaacgcgttattgccgcagttggtaccggaaaagcaactgacgcgggtgaatggatataatcaaatgttgatggcggctatgctcgtgatttccccgctgctggccgggtatattttgagcgatctggggattttttggatctttgtcatcgatgcgctcacagcggtactggcagtgttgtgcttagggattgttcacgtgccaacaccggtcaccaatccggatcaaacaaccaagcagcaaaatggcattgttgccggattgcgctacgtgggtcacacgccggtattgctggcatttatgctcttcaccggactggcgtttattttaattgccccttcttcccaattatcgacattatacgtcaatcgcacattcggttcggaggtctggcatctgacgtttaacgagtggtcatggacaattggtgccgggttaggcggtttgttcattgcacggcaaaaaaagtttcgggatcagcttggtttgattgcgcttggctttgcgggcagcggaattgcatttgccgaaatgggtttgaaacagccgtttataacttatttgctatttatgtttgtctcaggaatcttttatccgctgattcaggccgggcaaactatctacttgcaggaaaatgtgcctgcggataaactcggacgggtcttttcgctgtgggcgattttgtcgaccggaatttatccgttagccatgttgggttacggaccgctggcagatcgtgtgccgatcggatggattttcattgtgaccggtttgttgttaatcgttgtcgcttatgggttctggcggcggcttaagcatctgaatgggtcatcaaataagtagcatctcttattgaaaaaagaacgctatcacggtgcagtccacaactactgccaccgtgatagcgttcttttctgacggattaaaactgccgttgaactttgaaagccgtcggaacaggtttaaagtcgactttgggataaaactgcatggctgctggggccgatagcaacatgattgaaatgttgggtccctggatggtatgcagtgtttgcaatagtgccttgcccacaccttgatgctggtggcttttgacaacagctagctcggaaacaaacgtgcaataggacttgtcagacacaccacgtaaaacgccgattaactggtgatcatcccatgcggtgagcaacacatttgcgttattaagcattcgctgcatgcgcgcacgatcttcagtcggccggtgaataccggatgcatctaaaacggcaataaactgcgaggccgagatcggctgattattttcaatatgtaacaaggcttatccctcccgaccgatacgaaacatgttgtcagcgtgtggcaaattaatgcgttcatagaaacctactgcgctgtcagccgcgcgcaatgataaagtaacccttgggccaatgtaagcttgtaacgtcgcgatcaattgccgcccaatttggtggccttcataagcgggcagaattaaaatgtcactcagatagcaacagtactcaaagtcggtcagacagcgtgcaaagccaatgagatgctcatcgtcccagacactcaagaccagttgggtttcatcaatcatcacttgtagacgggcagcatcatcgatgggcttgtcaaaatgcgtttgctgataaagatcatgaacttgttgaaccgttaagggtgcgtttactttgatggtgtacgacacaacatcagctcctttataagtttgtcaacggtcaggttaccaaaaagaccgagcagcactcggtcaaggttcattatgaaaatcatatggcaggcacgtttttcaaagtaaatagtgatgtcattgacgatttatttgaaaacagtgactttgcttgccggaatgcgataaagcgagtccggtgcattcttgggtttgccaatcgcaatcagcaaggttggcatgaagtgggccggatccaagtcaagtgccggcagaatcttttcgtgatcaaagcctgtcatcgggccggtttcatagccataagcgcgggcggccaacatcagcgacatcgcggccagactactgttttgaatgatgaattcccgcaatgcttgtttgtcctgcttgaaatcagccaccaagtgatcaatcatcggcttttggtgttccactgcccggtcagtcaacaatccggccgttgccgcgcgtttgaacaaatcgtcttcaaatggtccaaggtctaattcgccgccgataagcacgaccgccgatgcagataagatttccggtgcattggtaccggcgacactggcaattttttccttggcggcattattttgggcgaccacgaaccgggttggctgcatgttcaaggcactcggcgctttggttgcgtaagtaataatttgcagcagttcccctttactgatggtgatttcaggatcaaattcacgggcagtatgacgcttcatgacaacttcatcaaagttattgttttccaacatcaaattcacctcttagattttttagacatcttcaggatacgctatatggtggcgttttcctagttgtttttaaaatggtataggttttgatggttggaatcggttgtcttagttttgcggtgttggcattgtcaggttcaatgcccctaactgtgaaatggcagccgtcacgtgatcacccggttgcaaaaagatttgcgggtcacggcccacgcctgttccactcggtgtaccggtaaagataagatctccgggttgtagcgccacaatcccggcgagatagtgaattaaagcaggcactttaaaaatcaattgatcaagtttggcttgttgcatgatatgcccatttacggtggtcgtgatttgtaattggtcgaggtttgtgatggcatctgttgacgtcacccagggaccaatgggtgagtagttttggaaagacttggctagcgaaaattgcggttcggcattggcaaactgtacggcacgatcgctgaagtcttcgccaaccaaaaatccggcgacatgcttaagtgcatcagcctcggcaatattgcggccacctttaccgattaacacgactaattcggtttcccaatcggttttgggcccatggataggtaccgtacttgtcggaccggtcagcgagctactgaatttagtgaagacgctcggaacttcgggtaacttgatgtgaatctcttgcgaatgatcaagaaaattcattccgatagcaaaaatctgggaactagcagctaccggcgcctctaattgttccggtttaaagttaatttcagaaccgaatgttaaggtgtcgcggtgggttaaagctgtcaaaacatcggcagcattggtaatgggttgcgctgttgatgcagacgttatcagatagggatggttgtttaatttggcaattttcaaaataaatgcttcctttcagatgagccattaaccacacctttagtttacgcctgcatggtggcggttccaatcacttcagcgcatttggcccagtgagttctgcctgaaaagtttcaatgatgcgctgtaccgccgtgttttgtacctcagtgccaaacgtgacgcgcagccagccgggttttaagccatcacggacaagaaaaccttgttgtagcaggcgcttttttaaagccgatgcctgcatttttggggcctgaaagaattgaaagttggtttggctccgggtgtgtggcagtccagtttgggttaaaaagcgttcccaactatcgcgcgcttgctgcactcgcttgcgtgtcatcgcgacaaaatcttgatcagccaaggccgcctgtgcgctaacttgggcaatgctgcttaaattgtaaggcagccgaacggtttgcaagtagttaacaagttgtttaggaaaaacaccgaagccgacccggaaattcgccagtccatagatttttgaaaatgttcgcagcacgacgaggtttggaaactttgataataagctgatagcgctcgtggctggatagtcatcagtgaactcaatataagcctcatccattaaaaccagcacgtcttttggtatctgtcgcagccattcggtcagtgtcgcaattgacagcagcgtgcccgtggggttatttgggttgcacacccaaatcagtttcgttttcgcggttagcgcctgcgccattgcagataaatcaaaattgccagtttcagtgacgggcacatcaatcacggtggccccttcaatttgggcatgcaagcggtactcggaaaatgttggccatggttcaatgacttcatcccccgggctcaaaaaagtgcgggcaattaaggcaatgacttcatccagaccattgccaaaaaccaactgctctgcggcaacgtctaaatgttttgccaccgcggtgcgtagttgactggcatagccatcggggtaatcacgactttgcgtaaaattccagttggtcacggcctgctgaactttgacgctggtaccgaatgggttttcgtttgctgacatccgcaccagctgtggcaagccaagttcttcttttaatacggcaagaggcttttctggcgtatagggatgaagttgatgaatggtgggtttaaacataaacaacgcctccttgtgatcttgtttggtttggccgagcttcaaacgtgagcgctggctggcaatcggttgtcaatatttgttgattttatcgcgctcttttaagcgactcatttttccttcacggctcgccagttcagtcgcaatctgatcaagggagatgccgcgttcgaccatgagtaccagcacatgataagtcagatcggcaacttcgagtataaaagccgcatcgtcgggatttttggctgcaacaatgacctcggtgctttcctccccgactttttttaaaatcttgtccaatcctttggtgaaaagataatcggtgtatgagcctgaaactggctggcttttccgtgactggatgagatcatataattcggtaatgctttgtttggcagctgtcattgggtgcccttcctttctgtatactgacgataaaaacaactggtgtggccagtgtggcaagcgggaccagcgggattgacggtgatgagtaaggtatccgcatcacagtcaacggcgatagcttgaaccgtttgggtgttgccgctggtttcgcctttatgccatagcatgttccgactgcgcgaccaaaaccaggtttcaccggtggtcatcgttttctcaaggctttcggcattcatataggcaaccattaatacttgcttggtcgttgcgtcttgaatgacggttgtgattaaaccggacgcctttttaaaatcgagtggtatcatcgaatcgccacctttgcttgttttagaactgtcttgacttgcggtatcgttaattcgccgaagtggaagattgaagcagcgagtcccgcagaaacattcgtattacggaataaggcaacaaagtcatttgcggatccggcaccgccgcttgcaacgacaggcaccgtaacaatggagctaagttgctggtaaagtcgcaggtcaaatccttgcttggtcccatcggcatccattgaggtgatcaatagttcaccggccccggccgcaactgcttgctgagcccacgtgagcactcctagatcaactggggtacgcccgccgttaatcatcacctgataacgattccggctaggttgccaacgcgcatcaatcgcgacaacaatcgcttgacggccaaacttttcggccccggcggtaattaaatcagggtgtttgaccgccgcggaatttaaggcaattttgtcagcaccggcacgcaacaattgatgcatgtcggtcaccgaacggataccgccgccgaccgttagcggcatgaaaacctgtgtggctaccgcagcgactgtttgcgtcatggtttgccgcgcatcggtggtggcggtgatgtcaagaaagaccaattcatctgctccctgcgcctcgtaagctttggcaatcgctaccgggtcgccgacatccttaagctggataaaatgaaccccttttttgacgcgtccttggtcaacatcaaggcatggaataatgcgttttgtcagcatcgttgtcctccaattctttaagtttgttcaagggaaaactgccggtctgccaagctttaccgataacagccgcctggataccggctgtttgcaaggctgtcagatcagccaaagtgtgcacgccaccactggccacgatattgacgttaggcacggtttgatgaagcattgcgagcaatgccacgttaggacctttcatcattccgtcgcggccgatatcggttacgataaaggtagtgacgccgcgcctgaccattgcctgcattaaatgcgttggcgattgggtgcttgtggtcagccacccatcagttgcaaccttcccggcgcgggcgtcaataccaacggcaattttatcggcgccgaatttctgaacggcctgtgttaccagttcggggttggtgacagccactgatccgagaatcaagcgatcgattccggcatttagatagtgatccatgatagctaaggtacgaataccgccacctagctcgataaaagcaggtgtgtgttgccgaatcgtgctaatgacggcttgattgattggctgttgggatcgggcaccgtcgagatcaactaaatgcaagtgtttaagaccagtggcggttaaatttttcacctgagtcagcgggtcggcagtcagactgacttggcggtagtcgccttgagtgagtctgacactttgaccggctaataaatcaattgctggatagagttgcatcagtcgtcatctccttaaaacgctgtaatccggcaagccctactgcaccgcttttttccggatgaaattgcgtccccagaatattctggcgccggacgatgctcgttagcggttgaccgtagtcggtggttgccaaagtgtaggcgggttgggtctggacgtaatacgagtggacaaagtaagtcgcctggttggcaaatccggctgcgaaaggatcaggttgggtgatcgtattggtgttccaccccatgtgcggtgtcgggaatcctgctcgtggtggaattgcgaccaccgtgccagggatgaggcccagtcccgctgtttccccgaattcaaagctgcgatcgaataacaattgcattcccaggcaaatgccgagtaagggtttgccggtagccgcaaattgacggataaccggaaccaggtcgcgttgggtcaatgcagacatggcggttttaaaagctcccactcctggcaggattaaaccggctgcagccagaatgacggcaggatcagctgaaagttggttgtcaatagccagataatcaagcgcttttttgacattcaacgtgttgcccgtatcgtagtcaacgatcacaatcatgaaatcactcctttggttgagggaatccccttcactgccggattcagcgccaccgccgcctgcatgctacggcccaatgctttaaacaacgcttcaattttatgatgcgtattacgcccgtataaaacagcggcatggagattgaattcacctgcaaaggccatagcctggaaaaaatcttccgtcacttccgtatcaaatcctccgagtcgttgattggttaattcagcatcaaacacaagataagcacgcccggaaagatccaccaccacgcgggcaaggctttcatccatcggcacaaatgcgttgccaaagcgttcgatgccagctttgtcacccagcgtttgtttaaagcaacttcccaagacgatgcctgtatcttcaatcgtatgatgcggatccacgtctaaatcaccttgagctttaacgattaaaccaaagcgtccatgtttagcaaaagcatcaagcatatgatcgaagaacccaatgccggtatcaatatcaataccgctttgctggtcaaggttcaaactaatcgttatcgcggtttccttagttgtccgagtgatcgttgctgtacgcatgataaacctcctagaaaagtgagcgcgagccggcgcggttagaagtcggagtgtaagcggccttgggcgtgatggcccggttttggccattgcgaccaaggtccttacacgcagacttctgcgccggggagcgcgttatggtgagagcgcgagccagcgcggttagaagtcggagtgtaagtggccttaagcgtgatggccgggctttggccattgcgaccaaggtccttatacgcaggcttctgcgtcgggggagcgcgtcctaaaacatcatttcaactcataaaaacatgctctaacgcgtaatccgtttcaaaatcgcctccgcatgcccatccagtccttcagtttgtgccagcgtcacaattgcatctgcttgagttgccaatgccgcggcactatattgaatgaattgagtacgcttcacgaagtcataaacgcccagtggtgagaaaaatcgtgccgatccggctgttggaaaaacatgatttggcccggcaacataatcgccaactggttcggcggcattttcacctaagaaaacggaaccggcattgtgaatttcattgagataagtgattggattgggtaattgaatttccaaatgttccggggcgatggtattcattaagcaaaatgcagaagctacgtcaggaacaatcgcgataaaaccttggttggtgatcgctgcttgtgcaatcgccttacgcggcaaacttagcagttgtgagtcaaccgccttactgacggcatctgccagcgctggactagtcgtcaccaacattgcgcgcgcgtttggatcgtgctctgcttgtgacaaaaggtcagctgccacccgtaccggatctgctgaatcatcagcaataatgccgatttcggatgggccagcgatcatatcaatcgcaacatcgccaaaaacctgttttttagcttcagcaacgtagcgatttccggggcctaaaattttatcgactttgggaatactttcagtgccataagtcaatgcgccaatcgcttgggcaccgccaacctgataaatttcgtccacccctgctagttttgcggccgccaatacagctggatttaaaccttttgcttgtggcggcgttaccatgacgattttcttgacccctgcgagtttagccggaattgcggtcatcagaatcgtggagggataagccgcggtgccgcctgggacatacaaacctaccgcggctagtggcgttagtttttgaccacggataacaccgggatatgggctatcaataaagccttggctcatttctagctggtgaaaactggtgatgttttttttggcaagggttaatgctgccagtaattttggcgagagatcagccattgcggcattgatttgcgcttgtggtacgcggaggtcggagatagcaacatcatcaaaagtggcattgtaggcaagtaaagccttgtccccatttagtttgacgtctgccagaattttttggacggtggtctgcactgccggattctgggcaacggtttgctggcgggtggtcacttgttgttgaagctcggttaaggtaccggtaagaattttcatgttaagcctcctgaggacgaacttgttgtagcgactgaataagctggtaaatggccggctttttttgttttaatgctaatcgattaaccaccagatgcgttgaaacgggcgttaaagtagcaaaaatcttgaggttgttttcgcgtaaggtggtgccggtttcggtgatatcgacaatggcatctgccatccccgtgagcggcgccaattctaccgatccttcaatcttgataatctcaacatcttcaccttggttttgaaaatagcgctgagcaagatgggggtatttggtggcaatcagtttgcgtttggttttttgcggatcaaagtcgggtgttgaagccaggatgaatcggcaccggccggttttaagatcaagcatgtcaaactgctgatggccttgttcttcaaggacatctgaacccacaatcccgatatcaacggttccgcgattcaaataagtgagaacgtccgcggctttgacaagaataaagtggtagtcagggttttcggtaaaaatcaaacggcggcttttagtcgaaagtgcctggcagtcaatgcctgctgcagtgagtaatggcaaaacctgagtggtcgtgcgcccttttgccaaggcgattgtgagggtcattgcattgcctcctttggggataaatcgattaatttggcgtgatacttttgcgccatcgtcttggcttcagcaagcgaatcgactaggcaaagttgtgcgtgcggggttgtcgcaacgactgccgcggcctcttgccattgagacggacggccataaaccagtgtgagggccggtttgggatcatccggcaaaatatcggttaaggcgtccacatcaaaggccaagccgacagctggcagcaggtcttgctgaaagctggccaacagttgatcatagcgtccgccactaaacagatattgacgactatcactggcgtaggcgtggaaaaagagcccggtgtagtaagattgtggcggttggctggttaaatcaacggttatcgtgacttggggaaattgatgttgaagaaaagcaacagtttgttgtaatggctttaggcgactgtgcagtaacgttggcggcaacagttgggcaagctgagtgaaaatcgtggcagcctcaccgaacaaccatggccattgctgcaagaatgggtataacggttccgcacgtaatggcgcaatgagttgttgataggtactgagattctttttgaaaaatgctgcttgcaatgcggatgctgtcgctggatcaagtggtaatgcctgcatgacttgcgatacgaactggacatcagacaattccaaggttaggtccgttaatcccaagtcttcacagatccgggttgcttcgctcaagcaggcccattcggcttttatcgaggcgtatccgattaattcgataccggcttgtgtcatttggttataggtaccacttaagctttttcggacgcgaaaaacgtctcccacataccaccattgaacaggaggctgaatgctggtggtactcagtaaacgcgctaacggtaatgtgaggtcgggacgcatcacaaccgcctctccggcatcatctaacatttggtaaggttgttcaccgcgaaccgtcaatggctggaaaacatcacggtattccaataatggcgttttaacgcgctcataccctgaagcaatgaatcggtggctcatcatttgaatgagattttctttacgaatcgcccggggaccgaattcatcgcgggtgccgactggtaagtgtcgatttgacatagggttgctccttccgtttgcacgaagctgtggtcattaagtgatcgcgtgcacgttttgttgggaaaaatcgaaacgaattcaacaaaaaaaacgccctcgaaaacggtttttaacgttttcgagggcgaatcaacttcgcggtaccacctcaatttgtctggaccttacgacccaaacctcatctaccaatcccatgtcggcttgcgcgaactgttattggcagcggtgataacgcaacaggtgcgtgatagcttactcggttcggctatcaagttcttagatgtgtgttcagtcggtcaatcacgcgttctcagcaatcggcgctctctgtggattggtgccaacctacttggtctaatcacaacttcatggctattgatttaatgtgactctcatcataacgacattttaaaaattgtcaaccatatttttttaatgtgcggcaaaaaaatttttcaatgatcgattatttgtttttttattttggcatttttataaacaaatatacaaaaattagctaatatttgaagtctgtttgattcctaaaaaagtcagtaacagttgttgaacttctgcatcttgctttggcgttccaaagctttgacgaatccagccaggaaccatgctgtcacgcaccagataaccgtgctgtttcaggaaagtgcccagtgcttgcggatcattgacctgatagagcatgaaattggtttgtgtggcataatggcggatttggtgctgatcaaaaaattgatgccactgcttccgggcggcaaaaatctgttgttttaccttgcgtgtgaatgtctgatcttcccaggccgctaaagccgctgcctgactcatgccgctgatgttatacgggagacggacattttgcattttggggatgagtgctttaggaacaatactgaagccaactcgaaaatttgctaacccgtataatttcgagaaggttcgcatgacgagcagattgggaaactgatgagtcaacgatagcgtggatggctcgggctgattgacaaaatcgatatacgcttcgtccacgacaacgagaatgttgggcggcacctgcttcataaactgcgcgatttgatccgggggcaaataagtacctgtcggattgttggggttgcatacccagatcactttggtttttgtcgtgatgtgggctaataacgcgtcaagatcaatcaaaccggttgcggcaatcacgggggcattaatcgttgtggctccggcaatggcggcttgtaactggtactccgggtaagtcggccaaggttgtaggctctcatcgcctacttctaaaaaagtgcgacaaatcaaagcaatcatttcgtctaatccactggaaaaaagtaattgctccgctggtatgtccaaccgtttggcaaccgcggtccgcaatggcagcgcatccggatcaggataattgcgtgcctgggaaaaggcccagttttcaagcgctgcctggacctttggcgaggtaccgaccggattttcattgaatgacaagcgcgtcattttagccaaaccggccgctttggcgattctttccggggtgctgtctgagacataatccggcagcccggcaatactgttgcgtaacattacgccacctgctttcttaattgtcttagagtttacccgttatcttggaaaatgtaaatatattatgcataaatatccacatgagtgcaatcccgtctgctcattttttgcgcaatcatgttattaaaaaagccaagccagtacgcaacagaatctgctaacgatgcggactggcttggttaaagttggttattcattcgtcataaaacggcaaaaatgtgcgctttattttttagcgacaaaggcgaggtaataagtgaccgctgctactgtctgagcggaattgattttgccacttttaactccggcgactagttcgctgaatggcacgagccggctggtgacaaattcatcgggatcaaaatcctgagaagttttggccgccaaatcaagttttgccaagacgagatggacggtttcatccgtcatgccttcgcttgaacggacggcggttaaccactgcagatcatgcgtgatatagccggtttcttcgcgcagttcccggctggcggcagtttgccaatcttcaccggcatcaatcaagccggcgggcaacgcataaacttcactgttcgtcgccacgcggtattcacgattaattaacacccgattgtcatgagtcaacgccaacattgccaccgcgttagcatgccgaattaagtcacgtttaacggttaggccatcaggcgttttgattttttgcgtcacaatgtcaaaaatcgggccatgataatgcggggtctcactcaaaatagtcccctttgctaaggggtgatcaaaaaacataccgccatctcctcaatgaaaaaagccgcgctgatacgcgacttgaaattaagctttcgtaaaatctttcatccatgccaacgcaatcgccttttcgcctaaatgggtaccgacaaccgggccaaagtaagacagctcgaacggtacattcggaaatttttgctccagatcggccatccagcgctgcgcttcttccggatcgtttgcgtggattacgaccgcccgaacaggatagtcaaccttcgccaatgtttcctggaaaagtgtttcaacacgcgcgtaagctttcttgatcgaacgtatcttttcaattgcaacgattttgtgcgattgatcatcaaacgtcagtaacggtttgatcttcagcataccgccgataaaggctgatgcattgcttaaacgaccacctcgtaccagattctgcaagtcgttgacaataaagtattcacccatggttgcccgtaaatcatccaggcgcgctaatattgcttgcgggtctttgccggcttctgccatttgtgcggctgccaggaccagccagcccattaaaataacggtgatctgggaatcataaacataaactttagcaccatgaacctcatcaaccgcaccttttaaagtattcacaaacccggagattgtgctagctaagtggatactaataatggtatcgtaaccttcattagcaaggttttcatataacttcagcatttcgcccagcggcggttgcgtggtacttggaaacgttttggcagttttgagtttggcataaaattcttgtgtggtaatatctttaccttcgtcataaacttcgccgtcaagaatgaccggaatcggcaccacagtgatgtgatgttgatcaatttcggtttgcggcagataacaggtactatccgtcacgatagcaattttcatacaggcacccacttcttcaaaaatgattgtctacatcataccataaaaaaacgagttgtaagcagcgcgcaaccaggagcgctcggaaatccaagcacgtttggctgggtttggagcagttaggttcgtggctttttgagtcaagcccaaaagctttagctgattaattggacccctcaccagtttgggtagttccgcttgtttgactgccagttgtaccggtcgtatcactgctgtcattgcccgatgttgcggtgtcactggaagttgcagccgtatcatccccggtttcattagatgtggttggcggcgtggcgggcgttgtatttgaaatgcctgttgtgttaccggttgccgcgccagtttgattccagtagccatagttattgtaatagggataagtatactgagaacttgaggtgttggcactgttgttaccgtacgtattcgcagtcccagccgtgttggcattagttgaacttgtcgctgcatcgtttgttgtggtctgattggttgcaggtgtcgaagtagcgatgttgtcagcagatgtctgcgtttctgcaggttggcttcgcttttccggtgctttttgagcgatttgtttctgatacgcccgcttcaacttgctggccttttgcttaattgtttgtaaaacatcgcgattgtagacaacaaggccttgcttggtcagattagccagcaatttctcaattccatcaagtttcttttgtaagtcggtgactgagatttctttgagcgctttttttgtcagcgtattgtctttgagtaatgcgttattttggtcctgaaaatatttaacatcgcgatcgacatagctttgataacgcgccaggacttcattggtcgcgttagtctgtttggcgtaacgcttttcggctgcttttaactttttaagtgtttgcagacgttgggtgtcgtttttttgtggttgaccatactgttgcttaagattattcaaaatcacctgagttttttcggtttgttgcttttcgccttgaacgtgctggtatttgacaacgcccaataataccgccgcagcaatcaaaaccactgtaacaagcaatataatgcttcgtttacccttcatttttcccaataccctttcatgaataactttttaactgccctgccccatgctgagcaattttacgaaccagacgctgccaagagcgatcaatcccaaaatattatgcgcgaagattagaaagccgggctagcctagtcatttcggttgcactatcaaatatattctacctgttgtgacgactattgcctaccattaacagacgataattagttttgatcgaaaatggtatgtgagcgtaagccgggcgttattgacagatatctcttaattcggcatgtcacgtggcgttgacagctttgccttacgcgcctaaaaccggtaaaatgattgggacaattggaaagcgagcggatcgatatgtcttttgacggaatttttacccatgccatggcccaggagcttaataccacgttaagcggcgggcgggttgctaaaattcaacaaccttatgaaaatgaaattatcatcacgattcgagctggacgcaagaaccatcccttgttgctctcagctaatccacagtatgcgcgggtgcaaattacccacattccatttacaaatccagacgttcctgcaaccttcacgatgacgttgcggaagtattttaacgcggctacgttaacagagattcaccaagtgcaaaacgatcgggtactacactttgaattctccacgcgggatgaattgggggatgaactggggctgcgcttgatcattgaaatgatgggtcggcacagtaacatctttttagtcagcaagcgcaccggcaaaattattgatctcattcgccacgtttctgcggatcaaaatcgctatcgtccgttgatgcccggtgccccgtatgtcgagccgcctaagcaagataaagtggatccgtttcatgattcggagcggatttatcacgaacttgaacgtcaggtaacaccttcattgagtcgcgccgccttgctccagcaacattaccaaggacttgccaaggattctgcagctgaattggccctgcgactcaatcaaggcgatgccggctgggatagcttttttgcagcgctggcaacccctgaaccgactattacaacccaagggaaaaaagccgtttttaccgcgatcccgtatcagtctctgaccggcgagcagcaacattttccaaccttaagcgcgatgctggatgcctattatgcgcaaaaagcggaacatgatcgggttttgcaacaaggcgggaacctgattcatgtgatcaaaaatgtgattgataaagatcgcaaaaagcagcgcaaattaaagcgaacgctggaagaaaccgaaaaagccgatgattatcgaattcgcggcgagattctgacgacttatctgagtcaagtcaaacgcggcatgacgagtattgaactgcctaatttctatgctgataatgagccaattaagatcaccttgtccaatcaactgacgccatcacgcaacgcccagaaatattttgccaagtatacgaaattacgcaatgcagtggcgcatgttcaccagcaaatgcaggaaaaccaagaagaactcgactaccttgaaggcatcatggcgcagattgatgtagctagtccgaaagatttagtcgatattcgattggaattacagcaacaaggctatctacgtaaacagaaatccggaaaaaaaggcaataaacgccaaaaagtctccaaaccagatcaattctatgctagtgacggcactaaaatctgggtcggaaaaaacaacttacaaaatgatcagttgaccctacacaccgcgaaaaaaaccgacatttggctgcacgtcaaagatatcccgggatcacacgtgattatcgatagcagtgatcccagtgagaaaaccttgctggaagcagccaagctggcagcgtatttttccaaagcgcgcgacagtgccaatgttccggttgactggattgaggttaaaaagattcgtaaacctaatggggccaaacccggctttgtcatttacgaaggccaaaaaacagtgagtgtcacgcctgacgctgatttagtcgccaagctgcgtaacccgccgacaaaataggagatgtcttttcatgtcagaatcatccgcccaaatcagccgcccacttcaggaacatatcattgccaacaaagtcaaacatggctggaataccaccgacactaactttgaaatgctgctggcttatcatgaaatggcggaattaacgacagcgttgcttaaacatgatcaagccaatatcgctgaagaactggcagatgttaccatttacctgctgggaatcgctgaaataaaaggaattgatttagcccaggccgtgaatgacaaagtgacaatcaatgatcaccgtgtatacgatgctcaaggacacaagcatttggagtaagtatgctggccttagtgagctaagattgctgataactttaaactacaaaaaatcgaccttaagctagcatgttgattgctgctcaaggtcgattttttgattaatctgctggcactaccctatcccaaaaacttaaagacaactttactatcaaatagcttgaatgttttttcaaatagtaacttacttaaaagtgcagcggcaattggcaccgcgaaccagcacagtaagaccaagggaattgccagaccggcatctaatgaagctagtgggccaaccataccgaccataccaaaaccggctgattgtggggttccgctgactcctagcagcgcaaccggaatggcagaaacgatggcggtgaatagacacggcagtaggataatcggatgtttaaacagattgggcatcattaacttcattgcgcccagtgcaattgccagcgtcacgccggatttattgacattccaggagaaaacaaccaacgcaatagcagttgccgccacacccatggccgatgcgcctgccgaaataccgttcagttgaatggctagcccaatggcaacggttgaaatcggactgataatcaaagtagcaaacgagcagcaaattaaaatggccatgagaattggctgcaaggtggtaaagctgttgatgagttccccaatggcggttgtgaaagccgcaataaacggtagcagtaagacacctatataagccgtaccacaaccaaccagaatcggcatggccactactgccgttgaaccgaaccgatctttaatccagatcaggagaagtacagcaatcgaggcagtaatcatggtattgattaaatcgccggtacctgaacccacataggctttcagcgccggattaaacttaacgactccggagccaacaaatgccgctccagctgtcaccatcatctgcatgggattcaattcgaactgtaaggcgatcaagcccccgataatcaatggcgtggcaagttgaaaaatgacggcaatctgtgtcaacgtcaccgcaaatgtattcgtacccagatatttcagaatgccggataagacggcattgggaatgaggccgataatgacacccaaagccgtacctgataagaccttattaagaaaaactgtcaccgttaatttggaagacttttgcttggcgtgccgatcttcaaccagcccgctttctttgccggcttcttcctcagctagtgcatgtgcagcagctgttaactctttatttgccgaatctgccatgggacttcacctcttctataatgttggatctatataaatcaaaacaaccatccgcttgtgatgattgttatgagaatattaacagaagatggcatatttagtccatagttaattttgatttaatactactctcacctttttaatatacgcaaaaaaatcggatgcaagatatttttaatcttccatccgatttttaggtatcataagagtcctacttgtgcagtatcgtcacaagcttatggtcgttaaaactgttcgccccacttggccggatcttctcgccattgatgcaacgaagccaattgggcactcgtaatcgccccttgcgcttcggcggtttgaatcaaggctgtgtaattcgtcaacgtgaagaacggtagccctgctttggcgaagtttgctgtcaccgcggcgagttggtaactgaaaatcgctgcgactccgagaacgttcacgccgtctttttgcgcggcggcaacggctccaagaaccgagccaccggttgacagcaaatcatcaatgacgactaacttggcatctgcaggaaggtggccttcgatttgacgcccctgaccatggtctttcggcttactgcgaatgtaaacaagtggcagattgagtaagttggcaaccaatgcggcatggggaatgccagcagttgcaacgccaccaatggcagtcacatcaggataatgggccacaatctcttgtgctaatccagccgcgattttgctacgaacgtctgggtagccgattgtgagccgattgtcggtatagatcgggctttttagaccactcgcccaagtaaacggtgcttctggtcgtaaggtaaccgctttgatccgtaacaagtcgctggcaatttgattttctaatttagtcatgtgctgtctcccacgctttcttaattgattgataggctgcaaccgggtcatcagcttgcgtaatcgggcgaccgatgacaatagccgaactacccagacgtttagcacggcctggcgtcacgacgcgtttttgatcgcccacagcggtgccgcgcggacgaatacccggagttaccaccagaaaatcaggtttggtgacactgcgaatgagtggtgtttccaaagcactcgcaaccacgccatctgcgtcactggcctgggcgatcgctgctaatcgttgaaccgcctggctaattggcatatcaatcgataactgattctccaacatagcttgatcagtggaggttagatgggtaatggccaacatttttggtgccggatggtgggctgccttggcaccggctaataacccgcgcttggctgctaacatcatgtctttgccgccagctgcatggaccgttgtcaacgcgacccctaaccgccctaactgccacgccgccttttcaacggtattgggaatgtcgtgtagttttaagtctaaaaatatgtcgacagggtgagcggcttgaatcgctttgataacggctggcccttccgcatagaaaagttccatgccgattttgacaaataatcgttcggtttgaggaaaagcctttaaaaaatctagcgtggtagcctgatctttgaaatcgagtgcaatgatgggtgtcataccgcctgtccttcctgaatacgtgcaaattctgcggcaattttggggattgcctgttcttggtaataattagctgaaccgatggcgattgccttggcaccggctgccagcatctcggctgcatcatgaccggaactgacgccacccatcccgataatcgaaatgtgaaccgcatgcgcgacctgatagaccatctgtaacgccatcgggaatagcgccggtccggaaacgccaccggttacattggtcaaaatcggttcgccagtttcgatgtctaagcgcattccgacaaaggtattgatcaaagaaatcccatctgcacctgctgcttcaacagctttggcaatcgtagtaatgtccgttacattcggcgtcaatttaacaaagataggaacggaactagctgccttgactgcttgcgttacagcagcggccacggagggatcggttccaaacgccatgccgccttggtcgacattcgggcacgagatgttgacttccagcgcttttacatttggggcggcgcttaactttttggctactgctgcatattcagcaacatcggcgcccgcaatgctagcgataatcggtaagtctgggtaatgggacgcgagccacggcaacttttcgtgcaacacgacctcagcgccggggttttttaacccgacagcattcagcgtactgcttggcccgtcagcataaatcttgccttgattgccgattcggggcattaaagtcgttgatttggtaaccaaagcacctaatagattgagatcatattgtttggcgtaaccttcgccaaacccaaatgtcccgctggcgggcataaatgggttcttcatcgtcaaacccggtaactggatggccatgtgcgcttcctcctccgctaacctgcgtatccttttttggatcagctgatactaactgcgaatcggtgtcattgagaaggcacgcgattccaatactttcaaaatggcatcggccgtgtcaaggctcgtcattaatggcacgccatgctcaatcgcggtttcccgaatgcggaatccgtcgcttgacgcctttttatctgccgtcatagtattaatgaccagttgaatcttgcggtcggcaatgtcttcgagaatggtttctttaccactgtcaagcttttcaatcgtcgcgaccgtaatcccggcggcctcaaacgcctttgctgtgccgctggtagcaactaactggtagcctacttcacggaagcgcttagccagctcggtagcttcaactttatcggcatccttaaccgtgattaaagcgcggccaaattgtggcaagtgcatacctgctgcttcgaacgccttgtataacgcctttgccagcgttgtatcgctgcccatgacttccccggtggatttcatttccgggccaagcaggctgtcgacatgattgagtttggagaaactgaagaccggcgctttgacgtgaataccagcttgattaggcagcagaccagtcgtaaagccttgttccttcaaacttaaaccgaggatcgccaaggttgcgacttgagccagtttaacgtttgtgaccttgctcaaaaatggaacggttcgacttgcccgcgggttaacttcaatgacataagccttgccttggtgaatgataaattgaacgttcatcaaaccgatgcagtttaaagcacgcgacagtttgatggttgcatcggtaatctggtcaataatatcctgactaaatgtttgcggtggataaacggccattgaatcaccgctatgaatgccggcgcgctcaatgtgctccatgatgcccggcagtaccacggtttcaccatcggaaatacaatcgacttcgcattctttaccgactaaatagtggtcaatcaaaacgggatggtcgtgcgaaaccgataccgcgcgatcaatgtaactcgccaattcgtcagcattgtgaacgatttccattgcccggccgcctaaaacataacttgggcgaaccaaaacgggataaccaattttatcggcgactgctaaagcgccatctttgtcagtagccgtaccgccttctggttgcggtaacttaagttctttaatgacttgatcaaacaagtcgcgatcttcggcccgattaaggtcggctaccgaggtgcctaagatcttaatgccccgttttgccagcggttcggctaaattaatggcagtttggccgccaaattgaacaatgacgccttttggttgctccaggtcaatgacattcaggacatcttcaagcgtcaacggttcaaaatacagtttatccgcaattgaaaagtcggttgagacggtttcggggttgctgttcatgatgatcgcttcatacccggctttttggatcgctttaacactatgaaccgtggcataatcgaattccaccccttggccaattcggatggggccggaaccgattaccagaatgcttggtttatcgctcttggtgctttccgtgctgctttcataggtgctgtagtagtatggggtgtcgctggcaaactcgccggcacaggtatcgaccattttataaaccggcaaaatatgctgttccttacgcatctggcgaatttggtcggcgtgcaatccccagagcttggcaatttcttcgtccgcaaacccataccgttttacttcggctagtaatgataaatcagctttgtgggcggctaattcccgttccaattcaacaatgtgcttgatcttgtcgaggaaaaacggattcattttggataattccgcaacttcatcaatcgtgtaatcacgacggaaggcttcggctagataaaagagccgttcatcgttggcctgaataatgtgtttgcttagctcatcatcacttagctttgaaaattcagggcgtcgcggatgaatcaaaccgacttcaagcgaacgcaccgcttttagtaagctttcttcaagtgtgcggccaattgccatcacttcgccggttgccttcatttgggtgccgagggttcgatcaccattttcaaacttgtcaaatgggaaccgcggtaatttggtgaccacataatccagtgccggctcaaattcggcccaggttttcttggtgaccgggtttttaatttcgtcaaggtttaagccaactgcgattttagcggccattttagcgatcggataaccggttgctttagaagccaaagcacttgagcgggatacccgaggattgacttcgataacgtaatatttgaagctgttacgatcaagcgcgaattggacattgcagccaccttcgatcttcaaggcccggatgatcttgagtgccgagtcacgtaacatctggacttctttatccgtcaaggtttgagttggcgcaaagaccatcgaatcaccggtgtgcaccccgactggatcaaagttttccatgttgcagacaacgattgcggagtcggaagcatcgcgcatcacttcaaattcaatttctttgtaaccggcaatggagcgttcgattaagacttgggtgaccgggctgaggttcaggccgttttcagcaatttcggctaattctttttcgttgtcagcgataccgccgccagtgccgcccatggtgaacgctggtcgaatgataaccgggaacccgattttgtcggcaaattcctgcgcttcttggacgttattggcgatggctgattctggaaccggttcgtgcaatttttgcatcaggttcttgaacaactcgcgatcttcggcttggtcaatggcgcttaatttggttcccagcaattcgatcccaagttcgtctaaaatgccggtattgctgagcttcattgcaagattcaacccgatttggccgccgatggttggtaaaatggcatctggcaactctttgcgcaaaatctgactgacaaattcgacagttaacggttcaatatagacgcgatcagcaatttcggtatcggtcataatcgtggccggattggagtttaccaaaacaacttcatagccttcttcacgtaatgcgagacaggcttgcgttcctgagtaatcaaattctgcggcttgaccgatgataattgggccagagccgatcactaagattttatgaatatcttgacgttttggcatgattatcctttctgcgtacgatctgagaatgcatccatcatttccataaattcatcaaaaagatggtcggcgtcgtgtggacccggcgcagcatccggatggaattggacggtgaaagccggatacaggcgatgccgcaacccttctaccgtgccatcgttaatttccacgtgggtgaccagcaaggtgtccgggtcaatgctgtcaggatcgacggcgtaaccgtggttttgactggtgaaatcaatgcggccggttgcaatttcacgaaccggatgattgaacccgcggtggccgtatttcattttgaaggtatcggcgccatttgccagtgcaaataactggtggccaagacaaatcccgaatagtggaatcttaccttcaatgccacgaatcatatccaatgcttccggcacatctttcggatccccagggccattggttaacatgacgccatccggtgctaattcaagaatggtggctgcagtggttgtggacggcaacacggtcacattacattgacgtttagccagttcccgtaaaatgctatgtttgaggccaaagtcaatgaccaccacattgcggccagttcccggtgccggataagcctgctgagtcgagacttgttgtacttgattctttggcagtaccaatgctttgagctggtcaaaggcatgttcgtcggcggcatccacaatactggctttcatggcgccgacttcccggatctttttggtcagcgcccgggtgtcaacgccgctgataccgggaatatgtttgcgcttgagaaattcatccagcgtcatctgactacgccaattaccggtgacccgcgcaacgtcccggaccacaatcccctttgcagtcggatcaatgctttcgtaatcatcacggttaataccgacattgccgatgagcggttgcgtgaatgtaatgatttggccattgtaactttgatccgtaatggtttcttgatagccgctcatgccggtgttaaaaacaatttcaccagtcgtgaccgtttccgcaccaaagccgacgccaggaaaaacactgccgtcttccagaattaaatagcgcttcatgcttgtcctcccttttgataggcgatttggccgtgactaatggtatataacgcctggccttgcacctcttcaccgataaatggtgaatttttaccttttgaaaaccaatcggcgggatcgattttataagaagtttccagatccaaaatggttaaatcggcgggcccaccaactgtgatgtgaccacctggcagtccgaatttggctgccggaatcgtgctcattttggcaatcagttgttggagcgtgaacattttggatttaacgaacttggtgtacagcagtggaaaggccgtttccgaaccgacgatcccgaatgcggcggttttaaacgatcccgtcttttcttcagccgtgtggggtgcgtgatccgtggcaatcatgtctagtgtgccgtcttgcaagccttccagtaatgccaaatgatcagcccgtgaacgtaacggtggattcattttaaacatggggttatcgccggggatgttattttcatcaagtaacaaatgatgcggtgagacttcagcggtcacgttgacgccgcgtttcttggcttcgcgaatcaaggccacactttggcgggttgagatatgacaggcgtgataatgaacgcctgtggcagctgccaggtctaagtcccgagctaattgactgctttcggtttggttaatgatgccaggcaggttcaattttttggcaaccggaccggcgttgatcacgccaccgtgcatgaggcttgcgtcttcaatgtgagccacaatcggcgcgtttaacttggctgcctgtagcatggctcgatacatggtgtcagcatcttgcaccccgacaccgtcattggagaagccaagtgcaccggctgcttgtaaggcgggcatgtcaaccacttgatccgagtgcaggtcccgtgtaatgggggcaaactggcgaacggtgattttggcatcgctacgattcttggccagtaacggcttcaaagtggcaactgtatccggcaccgggtttaaattactcatggcgacaacagttgtaaacccaccatgtgctgctgcctgcgcaccggttttaatggtttctttcgcggtaaaaccgggttcgcgaaaatgaacatgaacgtcaatcaatcctggcacaactgtcgcaccggtggcatcaatcaccgtttcatcggctcgagctgtcagttgctggccgattgccgtgatctgctcgccggtgatctgaatatcggcagtgtattcggtgtcgctaacgatgtgggcatttttgatgagcatgagttactcctctccgaagtgacgggcattgatgaccgcttccagcatggccattcgcatgaagacgccattttgcatttgcgtaaagatccgtgatcgtggtccgtcaactaaatcactggctaattcaacatcacggttaaccggtgccgggtgcatgaaaatggcattgggtttcatggttttagccaagtcatcggtaatgccatacttagcatgataactttctttagaaaaggcttcgcgattatcctgattgaagcgttctaactgaacccgcagcagcatcaacacatcgacctgtttaaccaactccggcacgctgatgaagtcgccataacggtcaaagctaggatcataccactgttgcggaccagcaaaatgtaacgtagcaccaagtttgtgcagcatctgcatatcactgcgggcaacccgactgtggctaaggtcgccgacgatcccgatgctcaaaccttcaaaatgaccgaattcttcgtgaatggtcatcagatccagcatcatctgggaaggatgttgccctgcaccgtcacctgcattcacaatggcggttgttggccaggcacccatgagttctttataatagccgtcttttgcgtgccgcatcaccgcaatattgacgccgattgccccaatggttttaatggtatcttccagcgtttcgccttttgatactgaactgtgggccgggtcgaacgggatgacggttagccctagtttgcgttcggccatttcaaaactggtatgcgtacgggtgctattttcaaaaaataaattagcagcataaattggttccggaaaatgaacggtttggccggctttgaagtcttcggcgcggttgattaacgccatggcacttttttcatcaacttgttcagcggaaacaaaatctttaaacggtgtatctgtcagattagataaggtcatttttctctgccccttcttcattagcggcatgttctggtaaaacaaagttcaggaagattccgatcacggttgccagtgcaaggccggaaaattgatagccggcaaattgcaggctggcattgccgatgccgatcacaagaatggtcgaggcaatcatcaggttgcgcttcttatcgaagtcgactttgttgtcaattaaaacccgtaagccattggaagcaatcaccccgaacagcaggaaactaatgccgccaataaccggacttgggatgctacgaattaatgcgcttagcttaccgatgaaggcgaacaaaatcgcgaacaatcctgcaccgcctaagacataaacactgtgtaccttcgtcatggcaagcacaccgatattttcgccataactggtgacaggcgggcccccgacgaatccagcgatgattgacgcagttccgtcaccggctaaggtatggttcaagccgggatccttaaagaaatcacgcttagtcaatttgttgagtaccatgatgtggcccatatgttcggtcatcgtgacaaacgcaatcggtgccatggataaaatggctccccagtaaagttgcggctgatagctgataaaaggcagttcaaactttggcagatcaaaccaggccgcttgttgtaccggcgtcagatcaacaatgccaaacagcaaggccaccacatagccggtgacaattccgagtaagatcggcaaaagactaataaactttttgagatacatgttgtaaatgatgacggatgccaaggtgatcatcgcaacggcaaagtatcgcaggtcataaacgctcttggtggcactgattgtacgcatggtcgcatcggtggcggctgtgcctgccaaggataagccaatgaccatgacaatcggaccgaccacgattggcgggagtgcccgatcaatccaagctgatccgctgcgagcaacaatcaaggcaacgatgagataaacgacaccgactgctacggttccttgtgcgatggctggataacccgcacctttcatcaaagcttgcatgatcgtgataaacgagaaactcgatcccatgtacgcaggaatcttaccacgagtaatcaggatataaactaaggtgccgacaccgcttgaaaataaggcaatgcttggatccagtccgactaaaatcggtaccagcacagttgaaccgaacatggcaaaaaggtgctggattgaaagtcccacccattgaccgaatttcggcttatcaccgatatccagtactgcttcgtcattatgaaaagccattgattattcccccatcttttcgatgctgatgccgtctttgccatcaagttcggccacctgcacctgaatttgctcgtcaagtgaggttggaatgtttttaccgacaaaatccggtcgaattggcaactcgcgatgtccgcgatcgacaagcacggccaagctgatcttacgtggccgaccttcatccatcaacgcatctaaagcggcgcgaatggtgcggccggtgaagatgacatcatcgactaaaatgacatgcttgccggtgatattaaccggtaactgtgctccttcaacatctggttggtgttcatggtcgattttatggacatcatcgcgataaaaccggatatccaattcgccaaccggaacttttaaaccttctagttgttcgaggcgtttggcgatgcggtgggccaaataaatgccacgggttttgatcccgactagaacaagatcgttcaaacccttattttgttcgatgatttcataactgattcgtgtcaatgcgcgtttcatagttacctcgtctacaacctgttttgactgtgccattgatgtgccaccctttcttgtatgtatgctgataaaacttggtgccagtgagtttgcttggtgatgaaagctgtgctccgacttctaaccaggctggttcacgctcggtcataacgcgttcaccagcccagaaacctgcacataaggaccttggtcgcaatggccaaagcccggccatcacgcccgaggccacttatgctccggtttctaaccgggctggttcacgctcactttctataacgcgctccccggcgcagaagtctgcgtgtaaggacctcagtcgcaatgaccaaagcccggccatcacgcctgaggccacttacactccgacttctaatcgcgccggttcacgctcaacaaaaaacgcctcctacccaatttggatagaaggcgaccgtagcctgaataatccgccgcaacggaaaggaaaccttctaagcctcactggacttagttaaaggtgcttgttcgattgagttaagattaccgaacgttgcgggtcttgtcaatgcctgcacgcagatcggttaaggttttttcaaaaattggcggtaccggcgcggtaaaagttaataattttcccgtgaccggatgcacgaagccgagttttgccgcgtgaagaaactgaccatgaccaggaagggtacgcttagggccatagagaggatcgcctgctaccgggtgatgggtgtaagccatgtgtacgcgaatctgatgcgtgcgcccggtatccagaatgcattttaccaaggtgtagtttgtaaagcgctccagtacttgaaaatgggtcacagcatggcggccatctgcgaccactgcttggcgtttgcgatcgcgcgggtcccgacccaacggcgcatcaattgtgccctcgtcttctttaaaagtaccatgaaccagtgccaaatattcccgaatcgacgttttagccttaagctgggcggatagacttagctgggcggcttctgtttttgcaaccattagcaagccgctcgtatctttatcaatacgatgaacgattccaggccgaatgacgccattaatgccaggtagcttggtgtgatacagcaacccattcaccagcgtgccgtccggatgacccggtgccggatgaacaaccatgccttgaggtttgttaaccacaatgacttgatcgtcttcgtaaacaatctcgagtggaatcggttcagcaacggccttaagtggtttaacttccggaatggtcactgtaacaacatcaccggccgtcaccttaaaattagctttcacgggattgccattaacggtgaccaagccgtcttggagccatttttgcacctggctgcgggtgtgggtggtctcgtgggccgtgatgatcttatcaattcggccgctttcggtggtaatggtgaaggtatcgctcatgctaccgccgccttgtcacgatcaaacagaatgtagatcaagacgaaaataaccccaagtgtgatgcagacatctgcaaaattaaaaatcgcattaaaacgccactgatcaagaaattcgagatggaacatatccgttacatatcgaaaacgcaaacgatcaataaagtttccaatcgcccccgctgtgatcaaggtcaaccccatccgataaaacggtttatgcagactatcgcgccacagcatggcaacaacaacaaacgctagaatcgtagtaacgtaaaaaaaccactgcttaccttcaaacatcgaaaaagcagcaccagtattacggatatgggtgagatcaatcacacctggaattaatgactgactgtcaccaagcggaatatgaaccctaacccaagtcttaatcccaaaatcaagcaaaaccaagacagcagcaaccatgacataaataagcaaagaaaaatcctcctgagcgcgagccagcgcggttagaagtcggagtgtaagtggccttgagcgtgatggcccggttttggccattgcgctcaaggtccttacacgcagacttctgcgctggggagcgcgttatgatgtgagcgcgagccggcgcggttagggatcggagtataagtggccttggccattgcgaccaaggtccttatactccgatccctgcgccggggagcgcgttatgatataagcatcagctgactcctacctcagccgcgcatctaatgtttgcttcctagtgtaccgcgcccaaagaaaaaccgccatcttgaaaatggcggttaacgtttatcgtagcgatggcctcattagaaaagtccggaaatcttaccatcgtcggtaacatccatgtttaaagcagctggtgcttttggtaagcctggcattgtcaaaaccgtgccggtcatgacgaccaggaacccggcgcctagcttagggataatatcgcgcacatgaatggtgaagccttcaggagcgcctagtgttttagggttatcggttaacgaatactgggttttagccatgcaaatcggtaagtcctgccaaccgttcttagcgatggttcgaagtgcagcatttgctttaccttcatagacaacatcggccccgccataaatcttttgaacaatggtcttgattttttctttgacgtcgctgttgcgatcataaagcggtgtgaagtgacttggctgattcaaagcatctaaaactgcatccgcaactgccaaaccgccgcggccaccatctgcccaaaccgttgcagtgaccgccttgacattgagtttggcacaggcatcaattaaccactggatttcggcatcggtgtcacttgtgaaccgattgaccgcaacgacaaccggcacaccgtaaccttgcatactgtggatatggcgtttcagattggcaaaacctttagctaacgcgtccaggttttcctgttgcagatcggctaatgcaaccccgccgttatacttcagtgcgcgaacggttgcgacgatgacaacagcatccggggttttacctaacacgggggtcttgatatccatgaacttttcaccgcccagatcagcgccgaagccagcttccgtaatcgcgatgttacccagttgcaaagcggtgcgggttgctaaaacggaattacaaccatgtgcgatgttggcaaatgggccaccatgaataaatgctggcgtatgttcaagtgtctgtactaagttaggcttcagggcatcgcgcaataacatggcaatggcaccggtgacttttaaatcgccgaccgtgacgggtttgcggtcataggtatacccaatcacaatccggccaattcttgcttttagatcggcaatgttttcggccagacatagaacggccattaattcgctggcgaccgtaatgtcaaacccatcttcgcgcggcacgccactggttggaccgcctaagccaattgttacatggcgcagtgcccggtcgttgatatccaacgcacgcttccacaaaattcggcgagggtcaatattgagtgtgtttccttgctgcagatgattgtcgattaaagcggccagtgtgtcgacggcagtggtcaaagcatgcatgtcaccggtgaaatgtaagttaatatcttccatcggtaccacttgcgcatagccgccaccggttgcgccgcctttcattcccatgaccggacctaacgaaggttcccgcaatgcgataacaggatgctggccgcgttgttgcaaagcatcacctaagccgacagtaatggttgatttgccttcaccggcgggggtcggattgatggatgtgaccaaaacgagcttgccaaacggcttatctttcaacgcattaagcgccgtaaagctgagtttggcttttgatttgccataaagttccaaatcgtcagcggttaaaccgatacttgcggcaactttcgtgattggccacattgagctggcttcgttagcctgggcaatttcaatatcagacatacaacacactccttatttagtggatgtttccaaacgttttttgatcaacgccacgattttttgttttcgctttttgccgaacatcagaaacgaaacgcgaccgtattgtttggttttaagcataacggtcaaacggccattcgtaaagtcctcaatgtccgcccaagctaaattaatcgtgttacttttaaaaaagctggttaaacgaaggcctttgggcgttgcgactaggcggagcaataagatttgaacaatcgcaactaaaattgtgacgcctgcaaccgcgaccgccagccatgataaactggtgctttccagctgaagaatgatcgctaaactaagtccaaatacgatcgcgctccaaaacatgctaaaatcgatccatgcaggttgataatgtgttcgatatcctgccaatttgccacttccttaggagaaatcatgcttaaactatacacagatggcgctacaaaaggcaacccgggaccggctggcatcggcattctggttagcggattgcctcagcaaattcaacatcatgccgctttacctgcgatgagcaaccacgaagcggaatttgctgctgccattgccgggtttaaattattgattgaatccagcttgacaacaggcacagtcgcttactacagcgattccaagttagtgattcaagccattgaaaagcgctatgccaaacactatccggcgttaacggcagagctgctgagcttaattgacgagtttccgctggtattacccaactggatcccggatcggcaaaatcgcggtgcccatcacctggctcaacaaggtttgcaccaagccgaaactgaaagttagtgtcagtcatcttgtcgtttcatggatcgattgacgtaaaaaaaagcctgaaactccagcaatattggaagtttcaggctttttgatcgaaacgtaccagcttgggttatagctgattatttaagaactttgaattgttgctcacgatccatgtaatccttggcatttgcttcgccttcgatggagccgaatggcatctgagcacgtaactgccagtttgccgggatatcaaaagcttcgcggacaaggtcgtcaatgatcgggttgtaatgctgcaggttagcaccgataccgttgttagccagcgttacccacgtgttaagctgagctgatccttgagactgttctgcccaagttgcaaagttatcggcatacagcgggaaatttttctctaactgttttacgacatcggtgtcagtgaagtataaaatggttgcaaaagcggctttaaaaccggcaatttttttcttggttgcctcgtaggcttcctcgcttggcacttcactctttaagcgcttgaccacaatgtcccataatttatcatgttgctcgccaaacaggaaaacggcccgagtagcctgtgagttaaaggctgttggtgtttcttgaataacggattcgattaatgcaaccaactcgtcaggattttgtttgatatccttgccgagtgcatagatggagcggcgttgtttgagcagatttagaagatcttgattcacgagataaccacctttttattattaatcaatacgtgttcgggcacacaccgtcaaaaccacccttacctatcactggctgtgaacgttaaaggcggggcaacgcatgtgagaacaagcataagtttaccaactgactattagtaagtaaacccccaagcgaaaatttcttgaaaaagcgactggctaaacttgcaatggtataccgaattctgcttagcgcttctatactataacgtgacagtgaccgttggcttgggtacaataaaattattcttcatggaggtgcggtatgtcgctcattacgtggctaattattattattttggttttgaataccattggggcgattttcaccgtcctccgcgaagtccgcgatatctcaacgacctgggcttggttacttgtgctgatcttcctgccgattattggttttggtttttatctatttgccggtcgcggcttgtcaaccaagaagttgcggcggattcaacgcgaatatgaatctggcgtgaaagccttcgtgtcacttcaaaaacatgaaaatgcgcgcaataagctattgccgcctacggattacacgccagcagctaaggcgttaacggccttttttcttaatacggcccaagcaccggtacttgcgcacaaccaggttcaactttacacggatggcgaaaaaaagtttgcggcgttatttcgtgatatcgaagcggctaaacattatatctatgttgagtattacaccatttataacgacgagctgggtaatcagtttcaacaactacttataaaaaaagccaagcaaggtgtgaccgtgaaggttttgtatgatgcctggggttcaatgggtgcctcggctaaatggtggcggcggctcactgatgtcggcggacaggcagaaagctattttagctcgaaacatcccatcaccgactttcggcttaactatcgcgatcaccgcaagatcgttgtgattgatgatcacgttggctatattggcggttttaatgtcggtgatcaatatgtttcgcgcaaaccgaaattcggttactggcgcgatacacatttacgcattgtcgggaacaccatttatgcgttgaaaattcgctttacaatggattggaacgcaactgtcgataagcaaaaagaaattgcctataacgtcgaacaaagcggtgccgaggatctgaccagcgaaagtatgaccgcaggcagcacgccgattcaaattgttgcatccggacctgaccgccccacccaacaaatcaagctggggtacaccaagttaatcactagcgctaccaaatcagtttggattcagagcccctatctggtgccagatgatacggtaatcgatgctttagtctcggcggcgatgtccggcattgatgtccgaattatggtgccggatatgccggatcatccctttattttccgcgctacgcaatattatgccaattatctggcgcgatcaggggttaaaatttatcactaccagcacggtttcatgcacgccaaaaccgttgtcgtcgatgatgcgattgccagtgttggctcggcaaattttgatatccgcagtttcaaattgaacttcgaaataaatgcgtttatttacgatcgcaaaattgccggaactttggccgaaatcttccaagcggatatggccaaaagctatctactgacaccggaaatcatttcgaaccaaggctggtggttacggtttaagcaagacttttccaggctcctgtcccctattctttaaattgcttcaaaagcctttcattataacgcgctcaccggcgcagaagtctgcatgtaaggaccaccccttaagcgcaatggccaaaacccggccatcacgcttaaggccacttacacttcgtcttctaaacgcgccggttcatgctcactttctataaggcgcaaatgataacaacgccggttcaacgatgtgatgcttcgttgaaccggcgttgctttttgaaaaatggctgatgaagataccgcgattaaataaaattgttaccgaaaaggactaaagccatctactgaacgacaccccgcgcttggagactttcagggccgcgcgcattaacgctgccaatcatccaataccttggtgtgaccaagaagataatgaatcgcagcatgaactaactcgtcgcgtgccgccaataactcatcgccctcaagattatacttatcgcgcaaataaccctctgcaatcgcttgatattctttgcgcgcctcgccgccatcgtttaaataagtatcaatcgcttccagattatctttggcccgattagccagttcttcggccagatcatcaacatgcggctgacgtttgtgagcgtaatccatcagcgtgtcattcatatcaatgacggccgcttcatcagctttcttgtcacgtttcatggttacttcatctcctaatactattagtatgcacctatgacctattttcatcaacgctgagcgcgaaccggcgcggttagaaaccggaacataagtggcctcagtcgcagacttctgcgccggtgagcgcgttatagtgtgatcccgtcttatattttccgattgttctgccagcaacaaagtaacggccaccgattaacgatgcaagagctggcgggagcggtggaacaattcttgataaagtgccgaccagctctcgaacctgtcactcgctaaataaaaaacaggcgtgtctggtacaatcggttcctcaccgggagccagcgcctgagcagaaatcacaaggtccgggtgttgggcaacagttaccagtcgaatataggcgggatgcatcagattaaggcggactgtttcgtacaaaggttgtggcatcatgggatcaagtgccactttgagtttatcggaaacggcactgtctgtcataaatggccaaagtaactgatagaatccgtcaacgatttcaggccgggatttttcagttggaagctcccgggcaaaaaaggccttaatagctgtctccagacgcggataaaacgcgcgcatgggactggcggttttggttaaatcaatgtaagcgccgcctggaaagatgcgttcgctaattaaaatttttaacaagttacccgccaaggcgagatcattggtcacggatggtgaaattccgacgagtcgtgtgctgagttcggcgcgaatcttagcgaccgtttgccatgctggcgtctcgttagcggcatgatagccgaccaaggtggcagcatcaaattgttgttccgtatgaaagcgtggaatccgccattgtccgagataaagatagagcatctcggcttcagcagtggctcgtggcaagtttgctaaaggagcaggtatttttttaggtaatgatggctgcggtttgagcgcagaaaagttcaaagtaccggcaattgagtggtgggccttaaggcgatgcaaattaatattggctgaaaatagcaactgggcgaccgagaaatcgcgttgtaccatgccggccgcttgcaacgctttgatgagttggcgcgactcaggcaaaatatcggcgaacaacggattcccgatatcgaccagttgccacaataattggcgatagatttggcgaattcgcggttcagaaccgatcagcgataacggggttaaattaatcgaaacttcggctcggcgcaaatagagtcgtaatgcggaaattcggcgaaaaaaagcagcgcgggaaaacccggtttcagtcaatagatctgaaagcgttgacgtgggcgccatcaaagttttgacaagtagtttccccggcagtgaccgccgatataaaaagatgcgataacgaacacgactgatggcaggcggtgccgtcatattgttatcaccgcggcgcaataacggcggtgcagcaggatcaatttcatgcaaatcagcggctaccttctccatgagtcggcgaagttgccgataactttcgccgcgcgccattgaggtagtcacaatgttaagctggtggttgggtgcgtcgcgtaaagtgccgtaaatcgctaaccggtctcgttcttcgcggtctagaaaaatttcttcaaacgccatggtgccgccttctttttcaaactttgctatagtatagcaaatggcgattgtaaactagctaaataatgcctgcttgaggccacccctattttgaatcatttttgccgctcattcaaagtcctcaaagtagcgaccacgttggcgtgatggttattagcaatatttaacgcgtccttttaccggttgccactggcgtttactatgcaatcttggtatactaaaagtaagcaaaaatcggatcgacaccatatgctcgggggcatcaaaaaaattaaccccaagatatggtgtttttcattgacaggcaccccaatattgagtattctaaaagacataagataacaagaaaggatgatacctatgcgtaacatcacactgtttacgcgcaatggctgtccgcaatgccggatgacaaagcgctacctcgatacccataacatttcatttaccgaacacaatatcaacgaagaacctgaatacatcgactacttgaagaaaaagggattccagcaggttcccgttctcgaagcagatgggcttgattcattctccgggttccgaccggatgccttgaagcaactggctgtttgatcagccagtttttttatcgcatcgaaactagcaaggaagattaaatgcagcgaaagcagggattagcatgtcactaaaaaccattagtccggatgaggttacttattacgcacttaacaacgagattaacattcccgttaacgaccaaattccgcttaacaaagataaagaagcattgcaggcctttttgaccgaaaatgttgcacccaataccatgaaatttgcttcattacaggagcgcttaaagtatctggttgaacatcactattatgaagccgactttttaaagaaatatcaaccagcctttttggagaagttgaatcagtttctcactgcccagcatttccaatttaagtcgttcatggctgcgtataaatattatgctcagtacgcgttaaaaaccgatgacggaacgcaatatcttgaagattacaaagatcgcgttttcgctaatgcccttttctttgcggatggtaacgaagatttggccgttgacttagccgatgagatgattcatcagcgctatcagccggctaccccatccttcctgaatgcaggtcgggcgcggcgtggtgaactggtctcttgtttcctgttgcaaatcaccgatgacatgaattcaattggccgggcaatcaactcggctttggaactttcccgtatcggcggcggtgtcggcttgacactgtcgaacctgcgtgaagccggtgcaccgatcaagggcattgacggtgctgccagtggtgtcttgccggtcatgaagttgctggaagattcattctcctacagtaaccagctgggtcagcgccaaggtgccggggttgtttatttgaacgtcttccatccggatatcatcagcttcctaggcgctaagaaggaaaatgccgatgaaaagtatcgggtgaaaacgttgagccttggtgtgattgtgccagataaatactacgaactcatcaaggctaacgctgacatgtacctcttctccccttattcagtcgaacgcgcgtatggcaagccattttcttacgtggatatcacgaaggaatacgacaagatggtagccaatcctgatattaagaaatacaagattaaagcgcgcgacttggaaaacgagatctccaagttgcagcaagaatccggctatccatacatcattaatatcgatacagccaatcgtgccaatccgatcgaaggtaagattatcatgagcaacctgtgttctgagattatgcaggttcaggttccgtctaagctcaataatcgtcaggagtacgaggtcttagggacagatgtttcatgcaacctggggagtacgaatattcctaacctgatgcacagccgtgattttggtcatagcgtcgaagccatggtacgcgcgctcacttatgtcacggatcacagcaacattgacgttgtgccgtccgtgcagcacggcaatcaccttgctcacagcattggtcttggtgcgatgggcctgcatacctattttgccaagaaccacatgtattatggttcaccggaaagcctggatttcactaacatctacttcctactgcttaattactacacgctcaaagcttccaataagatcgctaaggaacgcggcgaatccttccacaactttgaaaatagcaagtacgcagatggcagttattttgacaagtatctcaatcaaacttgggcgccgaagtacgataaagttcgcgacttgttcaaaaacattcacattccaacgcaggctgattggcaggcacttaaagaagatgtgatgaaaaacggtttgtaccatcaaaaccggatggcagttgcacctaatggctcaattagctatatcaacgacaccagcgcttcattgcagccaattgtcaaccggattgaggatcgtcaggaaaagaaaatcggtaccatttattacccggcaccgggactgtccaatgatacgatgccttactatcaaagcgcctatgacattgatatgcgtaaagtgatcgatgtttatgccgctgcgcaacaacatgttgaccaaggaatggcgatgacgttgtttatgcgcagtaccatcccagccggactttatccgtggaaagatggacgcacgaataaaatgactacccgggacttgaacatcttgcggaattacgctcattataagggcattaagtccatttactacatccggacttataccgatgaccaagaagaaatcggcagcaacgcttgtgaaagttgctcaatttgataatcttttaacagggggatctcccctgtttttacataaggagcgaagaaaatggcaaaacagtatattgcgattaactggaatgcaattgaagatgaagtagataaagccacttgggaaaaattaaccgaacagttttggctcgacacccgaatccccttgtccaacgatttggacgattggcgttcattgagtccggatgaacaatgggtcgttggccacgttttcggcgggctgactttactggataccctgcaaagtcaagacggtatggcaagtttacgccaaaacatccggacccaacaggaaaccgcggtgcttaataatattcagtttatggaaagtgtccatgcgaagagttattcatcaattttctcgacgctgaacacgcctgccgagatcgatgaaatctttgactggaccaatcacaatgagcatttgcagtacaaggccaacaaaatcaatgacatctatcacaacggctcggcactacaaaagaaaattgccagtgttttcctggaaacgttcctgttttattcaggcttctttaccccgctttattacctgggcaacaacaagctgacgaatgtggcggaaattatcaagctgattattcgggatgaaagtgttcacggaacctatatcggctataaattccagttaggcttcaatgaattgccggaagcagagcaacaacaactgcaggattggatgtacgatctgttatacgacctttatgaaaacgaagaaaagtatacgaacgatctctacgctaaaaccaaatggaccgatgaagttttgactttcctgcgttataacgccaataaggccctgatgaatctgggacaggaaaccgcctttccggataccgccgatgacgttaatccgattgtgatgaacggtatttcaacatcaacggctaaccatgatttcttctcacaggtcggtaatggttaccgtctcggtcaggtcgaagcaatggaagacgatgattattcattctcgactgaagataaagggcacaaggattaaaatgaccttgctcatgacagcaaaacagcctttgcagacaattagttatgtctcaaaggctgtttttgtttgcctgaaatcgtgtaaatgctggcgccaattctgataaatgacgcgtagaatggtgaccggcttttgcttataacctgaccacgagattagggttcggttttatcagacgcaatcttttcgtggacaagttccaaaaagtgttgcgcgatacgcgaaagctcccgatcccgtttccagaccaacgcaaccggatcggctagtgcaggcgctaacggacgaaaagttaaggaggtattagacgtttgggtagccagatattccaggcacaatgcccgccccaaaccgactgctgtcatgcctaatgcatcagcagttaagtcataagttccgacaatataggctggatccaatccctggccaagccaatgttcaaaactattgcggatgtgcgttgctcgtggcaggatcagttcactgtcactgatatcatttggcgtaattaacaggttatcagtaaggggatcgtcggtgtccatcaagattccccacgcatcacgcatgggtaacaacaaccgttcatattgcgtatgctctttacccggacgcagaataaagtcatacatgccggcttccaggttagctaccagactttcatctgatccatacgtcacgtggacatgtaagctgggatactgaagccgcaaagattgcgctaactggagcatgagttgtttgccgctagtttcgcctgcaccgatatagagatcaccgcccaaggcatgtttgccttgtaaattatttttggtccgttcggcaatggcggtcaattcgcgtgctcgatttagtagataggtaccatcttcggtcaaggtgacgcggcgattaccccgaatgagcaacttgacgcccagctctttttccagatccttgagctggcgcgatagccctggctgagatatacctaatgttctggctgcagcggtaatactgccatgatctgcaatttcaatgaagttgcgcaacgtctgcagttccatgttctcccctacttcctatcagtcctaattatcacaagtgctttcctataacaattatagcccattagcggcactttgtattccctttcacacatcatcctttatcttggccagtgttcgctcacctaatccgcttgaccgtgaagatgatactttgatccaaaaaagcatcggctcaagtgagccgatgcggatggtgctaccagatttgaacgcgtttttccggcggtaagtacatgccatcgcctggttgaacatcaaaagttgtataccaatcatctaaattgcgcggttggatgttggcccgtaattcatggggtgcgtggacatcgactgctaacaacatcttggcgcgctctaaacgagacttcgaacgccaaatgcgcgcccaattgatgaagaatgcgcgtaaatcagcatccttttcccgtttagccgtatccaacgccgctgctaatccgccggcatcggcaatattttccgaaaccactaatttgccgtttactttgccggctgccgtttccagaccgtcaaattcgtcaatcatggcttgggtcaattcatggaagtgatcaaaatcggctttttgccaccagttggccatgttgccgtactcatcgaactgggcaccattgttgtcgaatccatgagaaatttcgtgcgcaatgaccgcgccaatcccgccaagattttccgaagcggtttgctttaaggaataaaatggtgcctgtagaatggcggctgggaaagtaatgtcgtttttggacggatcatagctggcattcaccaagtgtccgggcatgttccataccgtgcgatcaacgggtttcgtcagtttatcaaagttatactgtacttgcaccttgcgcatggcaaataagttttctagcaatgagcgattgggatcaacatggagcagatcgtaaatggcttcaggatgatccggataccccatttttaataccatcttatttaacttaagaatggctttgtctttcgttggctgagatagccagtcagagttagctaagcgctgtttgtaagttgcaatcatcttttcaactagctgggtgacatcggcttttgctttttccccaaagtaggtccgcccataataaatgccaattggttcgctgaagtaccggttggcgacccgataagcatgcttaagctgatcaggcgatttcggtgcaccagataatgcgcggttatatgtaccgctcaattgccgcaatggttcgctcaagaagccggccacgtcacctagcgtcatgacataaagccagtcgcgataaagcttgaagttggcttcattaaataactggtcaaattcattcaaaaagcgcggatccgcaacaacaattgtttccggcacattcttgaaaatcgtctttaagaggttttcaaaattaaacggcttgagcttctcaatgaccgtgctagttggcgttgggttataggccttaggataatcggcccattcttcagaactcttgacgtgcttggcaatttcggcatcaaacgccaacgcgccttccaaagtggccttttgtgcggcttcgtccaaatcagtgtacgccaacagttgctgcatcatgtctttgaaaatgccaagcaattgcgcgccattttgattgtccttagcgtaataagacgtatccggcaaaatcgtttttggccccatcagattaatcacatttttgctggtatctttcatgtcggcatcaacaaaaaagttgaatggcggatcgattaaatgctcctgaagcaaattagcagcgcgttggttgtaatccgccaggtctttaatgcccttcaccaggtttaagcgcggttcagccggggcaaatccggcagcgtcccgcgttttaaagtccttagcctgttgatacagcgttactgcctgggcaaaatacttgtcaggtgcctgctttttgccatctgaaaccgcggcaaagtcagccatcatcttctcctcgacttcatcggcaagatcctgaaacccgccggtactacttttgtcgtcaggaataaccgcttgtttcatccaagcaccgttcactgcttgatataaatcgtcttgatagcgtacttcacttgtcattaaaaagctcctttcaccatgaaacgttatgtcataatcttaacgcacttctcattttcttgcacgactgattcacgtttcagtgcaataggacgcaataaattctaatttggccttaggtttttctcttttaatgaaagcgtgccgagtattaaagtcggcgggacaaaattggatcgcacagcgagttagattggcaaaatagattgttgtcaatcgaaatcgctttctttttggcgcataactcgttaaaataggccatgtactaagtcaacgatcgactaatcgtgtcagtcgttactggataacgcgtttgctggcacctgctgaagctgtcagccgatgctcataggaggatgtgcaaggatgtattatgtcattatgaagtctcacgatattcgtgaaaacttggcgactgagcaatatctgatgaatgccaagcagtttgatgaaccactgctgcttttttattatgaaaagccaagcgtgattgtcggccgtaaccagaacacgctggaagagttgaatcaaaagtatgttgaagatcacaatatcgttgtgacacgtcggctttccggcggcggcgcagtgtatcacgatttgggtaatttatgtttttcatttgtggtcgatagtaactccgaagaatttggtgatttcaagtccttcacgcagccgattgttgatgcgattcacacgctgggtgcgacaagtgccgaagtttcaggtcgcaatgacatgctggttgacgggaagaagttttccggcagcgcaatgtatacccgcaacggtaagacattttcgcatggcactttgatgctggatgtcgatatgagcgtcatccctaatgtgctcaacgttcctgaagataaaatcaagagtaaaggaattaaatccgttaagagtcgggttacaaacttgcggccttatctggataaaaaatatcagaatctgacggtgccggaattccgggatattttattgacccgtctgttcggtgttgacgatgtggccgccattaaagataaggaataccatgtgacgccagaagatgaagttgagattaaaaagatttatgacgatgtttataataactgggattgggtttacggtcatagcccagagttcaccactaagaaacgtaagcactttgattatgggacgatcgatgcgcggtttgacgtgaaagatggcaaaattgccaacgttaaattttacggtgatttcttcggcccacaggatgttagtgatgttgcggcagctttaaaagacaaaccgtacacatctgaagcggttaagaaaactttagatgcaattgatacaaacgcttatttcaccaacatccctaaagaagacgtcattaatttattagttccttaagcacattcagacttatttttctataaaaaggggcagccatttgtcggctgcccctttttgatcattcttgcaaacaatcaattatatttaacctggctaattgcatatgcctggattcgtttggctccccgcccagtttcaacggtaatgacaccgcgttcgttataaggcttaacggttgcagcctcgatatcaacgacgcgaccctttaagcgatggcgatcaattgtgttaattgccacctcctgttgcgtgtgcaaagcatcttgaagcaagttggtaatttcttctgggcgttgtgccataagaattcctccttcatcttaatggttagcatgcgtccatccagctaacagcatggatcaaggaaagttgcgctgcgaatttccttgaaactggctcttgctgacagacgtattcggttggggatactgtcgcaatctgatttgcaatcggcgtcacttaaaacgcgcgattgaaaacgattacgattccagtataacgattctgcggcaaaatttcagtagccgcggctaagatcaacttggtgactggctaactgaccgcttgctatcaaggattggaggttatcattaaaaattttaaaaacctgatcacgcagatgtggcacggtgccggaaatgtgcggcgtcaataaaacattgtccatgtcccaaagtggcgaatcttgtggtaacggttcaggatcaacgacatccaaggctgcggctcgtaactgctgggtctgaagtgcctgaaccaacgccggtgtatcgaccgaagcaccgcggccaatattgataaacaacggctgattttgaagcccggaaaagaattctgaattataaaaatgcttggtggcagaagttaatggcaatgcattaataaggatatcggcgttttgagcggctgtgtgtgcgttagcgtctgtaacgacttcctcaaacccggcagcaggacggccgtgtgcactcacgccaagcgtatgcagacccagtgcatgtaattttgtcgcaatcgttgagccgatatggccagtgccaaaaatgaccgcggtttggccttttaacaacgtcattggcggccgttgctgacggaaagtccacatctggcgaccggcgcgaaccggtggtagaatgccgcggctgatcgtaaataacacgccaaggacatattcagcaatcggttcggcatgaataccactcgtgtttgccaataatacctgatgtttagcaaagtcagccagcggtagataatcgactccggcagaaatagcctgaacaaagcgcaggtgatcgaaattcacttgcgcagattgatcgtgccatccataaacaacgtcaatttgctgggcggttgcttgatctaactgattgtcgtcaatcaccacgtgccctgctttttctaagacttgtcgttgctcaggtttgagattaaaactatttaaaattttcaaggtgtgcctccttacttgttatgatgccagttaggcttgccccagtattggaaaagatcggttcgaatggtgccattgtacaactttcgccgtttggttgcttgactgccatatgctttttcaaatcccatatcactggtcaaaatgtacttgctccaagtcgtcaacggcgcaaaggcttggcccatttccttgtaaagttggcgcaccatggcctgatcgctaagccgcttcccataaggcgggttggcaacaatgaccccgttttccttggtggtgctaaaatccttgacggctaattgcttaaagcgaatgctatgcagtaagcccgcttgttgcgcattcagcttagccatatcaatcatatcgccattaatgtcactagcctgaatatccagctcacggtcaaaatcggcggcgtccatcgcctgatccttggttgtttgcaagacggattgatcaaaaaagccgaaatcttcaaacgcaaagtgtcgttgtaatcccggtgccagatgatggccaatcaaagcggcttcaattgcaatcgtgccagatccggtcgtgggatcgacaaacggcatatcaggatgccagttcgtcaataagacaagcgctgcagcaaagttttccttcagtggcgcctcgccttttgcaatccggtaaccacgtttgaacaaactaggtccggttgtatctagcgtcagggttgcaacgtcttttagaatggagacttccagtggataagtagcgccggtttccggcaatcgcgtggttcgatgatagactgcggacatcttttcgacaattgcctttttggtgatggcttgaacatcgggctcagaatgcagttgggaacgaacagcccgccctgcaactgggaacgcagcgtctaacggcaaaaagttatcccacggtaatgccttaacgccttcaaataaatcgtcgaaggtgcgcgctttaaactgaccgatgacaattttgatccgatcagcgctgcgcaaccagacattggtcaacgcaatcgtttggtcattaccctcaaaatagactttgccattttcggtgcgggtttgaatacccaatgccttcagttctttcgtggtaaccgactcaaggccagccgccattgttgcgacaagttgatagttcatagcatgagttcctttcaaaattgtgagacgagattagtcattcaaggttagtttaactttttatgtacgttatggcgattgttgaggggcataactttatcgttgcggttaaggttgaggttgagtttggatggtggtttaggcgtggatggtcagaaagtgttcgggctttggctaatggaagtgactgttggccgatgctgctcataaacgcgctcacaggcccagaaacctgcacataaggactttgacccctaaatggccaaagaaagtttagacattggtcagtgaaatagaagttggccgatgctgctcataaacgcgctcctcagcgcagaagtctgcgtgtaaggaccttgagactaaatggccaaagaccagccatttagtctcaaggccacttacactccgacttctaaccgcgctggctcgcgctctcaaaaaaacagcccgggtttccccgggctgtgcctgcatgtagatccctataagccatgttttgttccagaacctgttcaggcgcgggttccttcagtcatcatctatctcagcgttgccgctgtattgccgtcgcttcagtttgcttggcaaaacgcccctaccaaaagtttgggttactcgctcgcggggtttacccgttccaccgttcaggtttccctgaacgtttcgtcactgtggcacttttcagacctactgacgcataaccgaagtcttagcgtggttggccgccgtaaccgttctcacggtccctaagcttattgggcttagcacgaacactacaagcatcgcagcttgtgcgggcatggactttcctcagcctgcagatgcagaccgcgatcactcaggatctacatgtgatcattaatactggtcaacgtcggaatggttgctgtcgtcgcggttatcaacactgccgctatctgacagttttgaaccgaaaacatgccgttccaaattactcagacgtttaagaatatcataatttgttgccgcagcattggtttgcggtgtttgtgcgctgacattcttggaaacactcagctgtttggtcagctcatcgacccggctaaacagctttgcattttcttctttcaaccgatcaatttcattggtgaaagcttcatagtcacgaatgatgccgtctaagaattcatcgacttcatccggatcatagccacgaaccttgtttttgaacttcttgtccaaaatatctttaggcccgtactggatactaaattttgtttctttgttactatccattccgacacacctcattgttttcatggaaccagactactaattagcttaccatatctcaatcattttgaaaatgctcattttcagcttcggccaattcttcggatgtttcttgtaaatcatccatcgtaatcagtgttaccggataatcacgtcgattagccatgtcttcggcggcacggtaatcccactgcggttttccgggaaattccggatcatagacaatcaccgccgcatctgtgtgtgccgtcataaaccgcgtataaccttgaagttgggcgggcttttgataaggtgcttgtgagactgcatcagagaaatcaacttgctggcgtaacgcagccagttgggccttattgttgtcattccactgactaccaaaatcggtaaatggcaacatcatcgcaattttaaacccaggatagagcggtttaagtgttaaggcaacttcgactgaccactgttcaacccccagttgaccgcctgtaatcagccaattgagcccttcgtcaagaaactgggtcagtgtgttttttaatgaagttttaaggactttcagttttggatcctgagccccaaaaacattgagctcataggcacggtaaccagttatccataacctttttcctgccatgatttccctccaatcattaggccaacgcgcttgatattggtataatagcgccaggagtgtgatcgcatgaccattcgttatcccaatggtaatccatacaaagacgggacgcaattttcaccagacgcagtgtcgcgccctaccatttatggcggacgcgggatgactttagaagaagaacttaacctcagcaatcagtattatcgtagtatcgacaaggccgttgtctataagaagccgacgccagtgcagattgtgaaggttgactatcctcgccgaagtcaggcagttatccgtgaagcctattttaagacgccttccacaactgattataatggtgtgtatcgcgggtattatcttgactttgaagccaaagaaaccaaaaataagaccagttttccgttaaaaaatttccaccaacatcagattgatcattttcggcgttgcttaaaacaaaacggtatctgttttgttgtgattcggtttgcaacgattaggcggctgtttgttttcccggcaggacggctcattacctgctgggatcagcaaagcgtaggcggtcgtaaatcgattcctctaaccaagatcattcaacacggatttgaacttcatccgcaattgcagccagttgtcccattccttgatggcgttgactggctgatagaaacgaaagtaggtaatgtacgtggctaataaccaaaacatgtcgcgaatggcacgacgccgcgaagataaacagtcaaaaagccctaaaccccccaagaaattatggcggcggattttaaaatggaccttgctcggtttgcttctcattttcattgctggtgtcgggttattctcctggtatgcaaaagatgcacctgaagtcacccaagcaaaactcgaatctggcggatccagtacgatttatgatcgtagcggtaatgagattacaacgcttgggctggaaaatcgcgactatgtcaaagcttcggagattccgcaacaacttaaagatgcggttgtttcaattgaagatcgccgcttttacgatgagaaattgggcattgatcctgtccgtattctcggtgctgcttttaacaacatgaccggaaccggtgacggcttgcaaggtggctcgacgttgacacaacagctcattaaactatctgttttcagcacaaaatcgtctgatcaaacattacgccgaaaagctcaggaagcctggctagccatgcaggttcaacaaaagtacagtaaagatcagattcttgaatattatattaataaagtgttcatgaattatggtcagtacgggatgagcactggggctaagttttattttaataaatcgctcaaagatctgagtcttgcacaaacggctttcatcgccggcctgccgcaaagtccggctggctacgacccttatgagtacccgcaaaaagcgactcagcggcgtaatgcagtcattgatgccatgttacgcgataagaaaattacggctgctgccgccaagcaagctaaagccacaccgattactgatggtttacagccaaaacaacaacagacaaacacaaccaccaatgataaagtgattgattcttacttgacgcaggtgattgcagaagttaagaagaaaaccggcttgaatccttacacggacaatttggatatttacaccaatattgacatgagtgcccaaaaacggctctacgatatcgtcaataccgatgattatgtcagtttcccggatgatgcctttcagaccggcgtcacgatgacagatccggataacggacaggtcttagcgcaaattggcggccgtaaaaccggcgatgtgcggttagcatacaaccgggcagcgcaaaatacccgtagtaatggatcgacaatgaagccgctcatggattatggtcctgctattgaatatcttaactattcgacttatgaacaaatgacggatgaaccatacaagtatcctgggaccacgatttcgttatatgactgggacaagaagtatcaaggtcggatttccatgcggacggcgcttgagcagtcccgcaacattccagccgtcaaaaccttgagtgcagtcggtatgacgaatgccgtgaagttcttaaagggactgggtatcgacttacctgcctcagaacaatatctttccagtgcgatcggggcatcggtcaacacggttgaagaagccggagcgtatggggcctttgccaatggcggcacttattacaagccttattacgtcaataaagtcgttagcgccgatggcaacacccaaacatttaacagtcaaggaacccgggcgatgaagtccagtaccgcttatatgatcacggatatgctaaaaggcgtgttgacaaaaggaacaggaacatcggcggctatttccggcctttaccaagctggtaagactgggacgaccgattatagcgatgaagagctcaagcagaatccggccctaaacgctacaggcattgccaaggacgcatggtttacgggctatacccgcaatcgggtcatttcagtctggaccggttatgataagccgacttctcatgggatcagttatgctgagcaaaccgtttcccagaagatctataaggcactgatgagttatacctcccagaaccttgataataaggattggacaaagccggatacagttgagtcgtacaatattctaaaaggcagcaatcccggcacagcgattacgagtggctcagccaacaccacgaaggagttgtacgttcgtggtcatggaccaagcagtcataaagcagtggctgaatcatcatcttcttccagtgccagctctgaatccagttcctcaaaagaatccagctcagaaagttcaaatgctgtttccgccagcatcgcgtcacatgcgacatcttccagtgtttcttctactgcgcctagttccgcagcaccttcaaaagaagaaacaagttccagcagtgagcctgtctcatctgctggtggtcctggtggtaatcaataagatttattcacgtgatttgaccatcaagagttttccctgatgaggattgccggacatcattaaaaaagcaccgctaccgatttgagatggtcagtagcggtgctttttatatgtgaaactaagcttgctgttctagatgaaccacggccacatggtgctgtgccaataacgtttcgccatacggatcattgcgatagtcatgcgcatacacaacacgcttaatgccagcctggatcaaggcctttgtacaattcagacatgggaaaaagttaacgtagacggttgcgccatgggtactgaccccattagccgcacattgaatgatggcattcatttcggcatgtatggtccgaatgcagtgaccatcacgcattaaatgaccggcctcatcacaatgcggatcaccactaatcgcgccgttataaccggtcgcaatgatccgatgttcctgaaccaaaactgcccccaccgttgcgcgctcacaagttgaacgttctgaaacctttttggcgagttcaagaaaataatgatcccagctttcacggtgaaccgtacgcttggatggcataatggcatctgtcaatgttcttccccctttaatggcgcgtaatgggtagccagaaacgtccattccggtccggatggtggctgtgggtctcgcgcgcgtaaatgttcacggccgaatcgaatcaaactgcggtgaagtttgatccaggtcgattttggcatcaaagtttcaagtcggctttggatttgaaccggtgttgctttaggtgaaaccaggcccaatcctttcacaatgcgactaacatgagtatcaactgccacgcccggtatgccaaaagcatcgctgaggaccacagtggcggtttttttaccaactcctggtaatttgaccaagtcagctgcattggctggcacctgaccgtcatatttttcaactaaaatagcactcaacgcttttaaatgcgccgctttagttcgatataaaccaagacgactgatttttttggcaatatcggtgactgaagcagcagccattgccgcgggcgttggatacgcggcaaatagttcgggcgtaaccgcattaacggctacatccgttgtttgcgccgaaagcatcactgccactagaatctgaaaaggattttgcgcgtgtaatgtcggctgtgggtcaggatacaacgccataatttgctcgaacaattgtcgggcttctgaatcagtcacacaggttcccccttttaaaatcggtttgattatgattccggtactgcctaatagttaaagttcttgatgacgcttgagctcggcttgaacctgttgcgcggttttaagatgccgtcgttcccaattcagcaaaatgcgatccatgtacttcagtgaatacgcggcattcaaaacggcttcacgtagcgccaataagattacttctggcaagtagtgatccgtcgttaaccagtcgcgaatcgtttcctgttcaattggtgaaagtggtcggccaaattcaatttcaatttgattaaagacattcgtttgcgcatcggcatttggttgggacattacgctgctatggcttttttggtttgtcggtatcttcgccagcaacggcgtgagatcatagtggtcgcgcattttaccctgaccatccggaatgctttcaagaacaatcgcctgtttttgaatcaacgtttcaattgctgtatagattgcattgggtgcgacgttcatgcgcgctgccaatgccttaagatcaggggcttgatgatgcttggattgccactgatcaatgaacagatacgttataaactcggtttgggtcagtcctaacgtaggatagtcatcaaacagcagattagaaacattaaactgtcccgcttcgatgtaccgttttaaatcagtcatgataggaatcctccaaaaaaagccggcgcgttggcgtccgacttttggttgccattacggctttaggcgattgatcattcgtgggaatgggatggcttcgcgtaaatgatccaacttgcaaatccaggtaatggcgcgttcaaggcccaaaccaaatccggaatgcggtactgaaccgtacttgcgtaaatccagataccattcgtattcatctaaatcaaggccggccttttcaatggcagctttgagcttgtcataatcggtttcacgttccgaaccgccgatgatttcgccgtaaccttctggtgctagcatatcggcgcagacatattgctgctcatcttccgggtccgttaacatgtagaacggtttgatggctttaggataattcaacacaaagacaggctgatcaaattgatctgacagatacgtttcttccggcgagccaaaatcatcaccgtatttgacgtccatccctgctgcctgcaacatttcgattgcctttttgtagctgatgcgtggatatggcagcttcgtatactttttgagtacttccggatcgcggcctagcaaatgtaacggataggcgcagttatccaataccgcctgcaccatataggcaacataacgctcttgaacttttaaactctcttcttgatggcaaaacgccatttccggttcgatcatccaaaactcggtcaaatgccggcgggtcttacttttttctgcccgaaataccggtccgcacgtgaagactttaccataggccattgcccctgcttcagcatacaactgaccggattggctaagataagctttcttgtcaaaatagtcagtttcaaaaagttcggttgtgccttcaggtgccgaatcagtcaagatcggcgggtccattttgataaagccttcattgttaaagaattcaaacgtggcgcgaatcatttcgttacgaatttgttgaatcgcaaattggcgctttgatcgtaaccaaagatggcggtgatcgagcaggaactcaatgccatgctctttaggcgtaatcggatagtcgtgtgaatccccgacaagctcaatgttgcggacttcgatttcgtagccaaaatgactgcggctatcttggtgaatgacgccggtgatccacatgctggactcttgacgtaattcctttgccagctgaaagacctcatctggcacgtcggctttagaaacaacgccttgaaaatacgcggaaccatcgcgtaactgtagaaaggcaatctttccggagctgcgtttatcggttaaccacgccccaattgttacttcttcgttcacatgttcttttgcatcaataatgcgaatcttttccgtcatgcgttaactccccacttcaataattatttaccaacaaactcccggatacgccgggcggcctctttcagactggccaaatctttacaataactaatccgcgcatgatccggcatgccaaacgcccgtccaggaacaatggcaaccccggtttcggtcaacagtgcactgataaaatcatcaaccgtaccataatgactcaattgagcggcacgcttaatattcgggaaaagatagaaggcgccttgcggtttatctcccatatcgaaaccgggaatatctgccagaagatcatagaaaagattcagccgttcttcaaaagcacggcgcatcttttcaacaacctgctgatcgccagttaaagctgccaccgcggcgtattcggaaactgctgccggattagaggtcgtgtggctaataaaggtcgccatggcctgaatcagcttttccggaccggccgcataaccaatccgccaacccgtcatcgcatatgacttggagacgccggaaattaaaacagtattcgctgcgatatcgggatcgatactaatcattgaggtgtaagtcgtaccgttataaatcagatctcggtaaatatcgtcagtcactaccaaaatatgatgcttcagcgcccaattgccaattaaggtcagttccgtgcgatcatagacaacgccacttgggttttgtggcgaattgataatcaatgcccgggttttatcggtccgagccgcctcaagatcatcgacactgactttatgtccgactgccggcatgaccagatgtggcacgccgctcgccaatttaatctgttcctcgtaggaaacccagtatggaacaggaatcagcacctcatcgcctgggtttaagaaaacctgaaataaggcatacaaagcaaacttagcgccggtggttgcaacgatttgacgatgatcataacgaataccgtcttgggcaaatatccggtcactaatcgcctgctttaattccggaataccggttgctgccgtatagaaactggcattaccagcctgaatcgccgcaatagctgcgtcatcaatcgccttaggggttgaaaaatctggttggccaatagacaaatcaatgacgtcggcaccttttgcctttaagtctttcgtctgattacttaaggccaatgtcgctgacggtgcgacgttgaggattctttttgctaaatgcacgactgcgcctcctacagcttcggcaccattgcggctaccgaatcatttttaattataaatttttgatcgcgttcaattgttcgccgctgcgaaaactgtacgtcacgtagttcagtttaccagactttgacagatagccaatatcccagacaaattccgatcctcttttacccagtgatgcattcagaattttcttgggagcgctggtttgggtcacctgttgaatggctttttgccgggtaataccggacttttggtttaaaatcgttaccttgcctgtctttttctgaatcacgacgtaaaccgactgattcttcttggtttgaccggcaacggtgagataactcttatcacggttgtaccaccagaagccgttcacgttttttaaatcagcccgattggtagcaattttttccgcttggtcgcgcaattgttggtaaggtgacagactcttggcataaattccgatggcagcgatgatgagaacaatcaggccaccgataaataagaatttggcccagtcgaaacgacggtgatgacgcatcggtgctcccctccttttgttgggtatggttggttgagaattaggtgatgataagccaatgctgttcgtgaacgcgctcacaggcctagaaacctgcgcataggggtcttgattccaaatggccaaagtgtggtaaactcgggcaactttttggtgtgttgaccgatacctttcgtaaacgcgctcataggcccagaaacctgcacataaggaccttgattccaaatggccaaaacccggccatttggaatcaaggccacttatgttccggtttctaaacgggcctgttcgcgctcttgcttcttaaccacattctaatgtaccccggaatatcggtgagtggcaatgtcattggtttaatatttggtaaggatttttgcattttcttaccatacgcggtggtgatgaagcgtggatcgaggatgatgaaggcgccgcggtcggtttcggtgcggatgaggcggccgaagctttgacgcagccgcaagatcgcacgcggtagggcatcttctgtgaacggatcgccgccgcttaattgaatctgacggtatcgggctttggtgatcggcgcttcaggcgcatcaaagggcaaccgcgttaaaatgacgatttcaagcagtcgatcgggataatcaatgccttcaaaaaagcttgctgcccctaagagtaaactttgctcgccaactgcaaaccgtttggcaattttttccgctgaaccggtgacaccttgagccaatagctctttgtgcccggcaattggtcgatggatcaaacgttggtagacggcctcaatgacggataaagaattaaataagacaatcgtttgatattgattatccgccagttgttcaatggccatcgctaaataatcagcgtaggcatcatccgagacgtccgcggcatgaggagcatctgttgccactaaaaccttggcctgatcgcgataatgaaatggactgcggagttttaagaagctggattccggtaattcgtgatagcctaattgggcagttagaaaatcaaatgaacgctcagccgtcaaggtggcaccgacgaatactggcgcttcaaaatgatgaatcagttgctgaacggcagatccgacttggaaaacatcccaacttaattccagactcgccacatcggtaatctggcgtaaattaacggacataatcaccgcctgcccggcaattaaatccggcaaccggcttagtaactcttgaagaagctgacgatgatctgccaaggcgattcgcagcgctgctaacgcttgaaactgctgcccatcgctttttaagaagaaatgcggtcggcggttaaaatcagcggttaatttgtcagttgtgaccgtcagcctcccaagaactttaatgagcgatttgatggtggccgtttgtgtctgttcgagccacttggccgctgctgaatccaaacttaagttcacaaaacctgaagctgcagttgttttgccaaagaagaagtggcgatggatctgacgctgcaaggtattcacagccgtctcggcagtggctgcctgttgattcagttgctgtaacaccgttagcatggcaggttcactttgataaatcgctgtcaatgaatgccgttcgtctggttcactcaattgccatacacgatgcaactgatgatttaagtggtcaagcgccacccgccgtgcaaacgcggcagcagtattgtcggcaaagtgctgcgcctcatcgactactagaaatggccgtttaaatggtaacgtgtctgcatgccgtgaaagaaacgcgtggtttgttaccaccaccactgcatcagccagtttagcctgcagccgccgataaaaatcgaacgtataaaaaggattgatgaatggcgtgccaacatcaccggaatgccggatttcagcaaacaacggcgcgcgataagtggttaaatgcagctcatctaaatcccctgtcgttgtttgagtcagccataccagtaatttcatttgcaacagttgggtttggcgagtcggtccttcttggtgaagactagcagcaaatttattgagatcaagataatgctggggacttttcagctcaaccgtgggtaacgtgcgcccaagcaaggcatcaagttcgggaatggcttgcgttatcagctgcgtttgcaaaaccagggttgacgttgccacaaccaacttttgctcaggtgtggcaaggtaagcataaggcagtaaatagcccaatgtcttccccaagccagtccctgcttcgatgaataatggtatttcggttttttgcgcatgcgtgaaaatggcatccatcatcttggcctgtgctttacgaaagcgatagcgcggctgtagcagatgttttttggctagttcggttgctggataagcgccagccgttgccaaatcggttggtgtagtcgtcggccgacgtaacaccaatggcccgacctgaacaaattctttttttaacggtctggggggtgacgcgatcattttcagataatcaccggtttcgcgaataaagccatcgtgacgctgaatcaaggcctgttgcgttggtgtcggtaaggcctgaaagcgcgcctttagttgcaacagtagtttcgcggtactggtagcgtcactatcggcttgatgcgggttgtcatgttggatcgcaaaatgagtcgtcaaatcactgagtcgaaaactgctgatttctggaagtaacacctgtgccaactcaacagtatcaatcgcctcaagctgtaattttggtaaaccgatacgctcaaactctgcatttagaaacggataatcaaaattaacattgtgcgccacaaagaccgtcttagttagcacttggtgaagcgcgggcgctacctcatcaaaatacggcgccgcgactaaccgttcagggctgattccggtcaaccgctggatcgtctgcgggactgaccgatccgggttgatcatttgtgaaattgtttgaatgatcttgccatggcgcaccaaagcacaaccgaattgaatcatacggtcgccgtccttgacactggttccggttgtttccaaatcaaccacagcaaaagtggtgtcagcattcatgaacttttaaccattcctgtctaaacatactgcatctatcatactatttccctgttgactctgctactaaatccacaatcgttcctgttcgtaacaagaccagataacgatgggtaaccggcttgggttgaagttgcgtcaaggcctgagcgtataagttcagttggccacgataacgcgccactaattttgccggatcgggctcgtgatcggttttatagtcaaacaacgtgacaccatcggcctcagttacataaccgtccatgatcccgtgaaccaaaacatcctcgccggggtcattttgtaaaatctcaaacaactgattggcaggcaacaacatggaaaacggcacttcccgttgcacctgttgcggcttagcttgcaataactgtcctagatcggttgcaaaaaagcgcaccaaagcagttaggtcaatccgcttggcaacctctgtcggcatgaccccggtggttatcaagtggtgtcgcaaggcttctagactgtttagcgtaatcggtttggtcaggtcaaccaattggagcaataaatgcgtcgccgttccaatcgcagcagcattcccaccaccgtaagtttcggtcaaaaatgccggcgcacctaaatcgtgtagcggcggtttcggccctaaaaatcggtcggcactcactagttccatcgtatccggatcgtcaaaagcccgcttgatttccgaaacactttgaaagcctgccgttgtcgtggcagcttggaatggatactgcgtggcaaaccatcctgtcagctcaattgccggtgcatctgttttggctggcgttttggtcgccgctccgactttaatttgcggatgggtctcgattgcaatcgaaaactcggttggatcagctaccaaggccggtttgacggtggtttcagtcagtcctttgacttgcggatgacgaatgagggccggtccgatccaatccagataattcgttgccgccccgcgaatttgcggtgcaagcgtgagctgttcaccttccgcggccttggcccacttggcaaccgttttgtcagccgaagttaattgctgcccgctcatggttgcgccaacaacatagaggcgttgctgggcacgcgtcaacgccacatacaaaagacgcatttcttcagccaatgtttgattttgtcgagcggctttggcggcttggtattgcggtaactcatattccacccgggtttgcgggtcaagccacttaataccgatcccatttttagtcaaaattgccggtccgctttgatcgcgacggttaaagtgtttgttcgtttgtaagacaaaaacaaccggaaactcaagccctttactcttgtgaatcgtcatcaatttgacggcatcgttatccggatcaacctgagccggtgtggcaaggtcctgatcctgcttttgcatcaaggtaatgaaatgaatgaaggcaaacaaacctttaaagccgccagattcataagtccgagcacgatcaaccaaggcaagtaaatttgcctggcgttgactgccgccaggggtgccgccaacataatcgagaaagccggtttcctgataaattgcccacaacaatgtcacgagatcattttcccgggccagatcgcgaaaatgattgagttggtccaaaaatgtggtcaacgtggcgtgagtgcgtttagccagcggcgttgtcggtgttccggtgagaaaagcggtcaccgcgtcataataaggtacttgtttggctgccaatcgaatcaaggctaactgatcagctgagaggccgacaatcggcgagcgcaaaaccgcaactaacggaatatcttgcttaggattatcgatgattttgaggagtgccagcatcaccatcaattccgtcgtcttgaagaaattcttggtatcagccacgaataatggtacgccggctgcggcaaattgggtttgaatgaggctgttttgggtggtttggcgtgttaaaagcgtaatatcgcgataccggatacgccgatattgctggttggcacgatcccataattgtgcatcgggatcctgaactaaccgctggatctcggcaatgaccatttgtgtttgaccggttgcaacatccagcggctcgtcatcttcatcggttgcagaccagtccgaagtcgcgttggtttcgtcatcatcgtccgaagtcgctttgctatatagcatgactttgaccgctgggtggcaatcgccataatcaagcgcaccatactttaacgcagcattgtcgtcataagccaaatcgccgacttcaggatccataatctggctaaaaataagattggtgaacgccaaaacatttttagtcgagcgaaaattttctgccaaaataatccgttcaggcgcggtgggtgtttccggatgacttgcaaacgcctgatatttttgaatgaataactgcgggtcagctaagcgaaatccatagatactttgcttcacatccccgaccataaagcgatcgccggggtcggttgtgctgacggctgccagtaacgcttcttgtaaggggctaatgtcttgatactcgtcgaccatcacctcatcgaaactggcgcgataattgtcagcaatcggtgcgccggtttggggatctttttgctgcaggattcgcagtgcgttatgcgcaatatcgctatagtcttgcacatgccgaaccgccttttctgcggtcagcgcatctaaaaaggttaaggccacctccgtcagcatggtcatcatcggttgcactgtgtggagtaagtcggtgatttgctcacttgttaaggcaaaatccggtgctaactgatcctgccatatttttttagcggcatcccgctgttgtttagcctcatttttgagtgctttgtcgtcgtcgtcaagacctttgctggcgcgagaccacgctaaaaagtcatgctgaactaagaccccgcgaaccgcttcatagctcggcttggggttgtctaataaactttgtaacgggttcaaatcggctgtgatttgttgatgccagactggatttggcaagcggttggccagctcatccgcttgcgtcagcgtggtgatcacttgcatgagtttgcgtttggttcgcggccaaatctggtgcgtgaaggtcgccgcccaagcttctggtgcataaggctttgccagttgttgcaagtaagctttgggatcggttgtggcagcagcttggcgcattaactcgaacattaaatcctgaaggccactatcatcccgatcgccgctaaagttagcggtcaattgctcgaattccgccgcttcgtcaccagcataaaattgttcgcgcaaatcgttccaaacctgttcttgcaacatatagcgttcagtttcatcggtcagtaaccgaaaacccggatccaaatcgatgacatag

(The sequence listing continues in the following parts.)

What is claimed is:

1. An expression vector comprising a nucleic acid sequence encoding a functionally active type 1 Bacteriophage Exclusion (BREX) system comprising a pglX polypeptide comprising an adenine-specific methylase domain (pfam13659, COG1002/COG0286), a brxC/pglY polypeptide comprising an ATP binding domain (pfam10923), a pglZ polypeptide comprising an alkaline phosphatase domain (pfam08665), a brxL polypeptide comprising a Lon-like protease domain (COG4930), a brxA polypeptide comprising a DUF1819 domain (pfam08849), and a brxB polypeptide comprising a DUF1788 domain (pfam08747);

wherein the amino acid sequences of each of said type 1 BREX system polypeptides, are set forth as follows:
(a) the brxA polypeptide amino acid sequence is selected from the group consisting of SEQ ID NOs: 4953-5064, 5102-5367, 5399-5414, and 6225;
(b) the brxB polypeptide amino acid sequence selected from the group consisting of SEQ ID NO: 5570-5686, 5698-5939, 5944-5947, 6206, and 6227;
(c) the brxC/pglY polypeptide amino acid sequence selected from the group consisting of SEQ ID NO: 615, 617-735, 818-1110, 1170-1175, and 6229;
(d) a pglX polypeptide amino acid sequence selected from the group consisting of SEQ ID NO: 2766-2916, 2954-3251, 3276-3280, 6182, 6190, 6192, 6194, 6196, 6198, and 6231;
(e) a pglZ polypeptide amino acid sequence selected from the group consisting of SEQ ID NO: 1716-1834, 1905-2192, 2248, 2250, 6204, and 6233; and
(f) a brxL polypeptide amino acid sequence selected from the group consisting of SEQ ID NO: 4028-4298, 4300-4402, 6165, and 6235;

said expression vector further comprising a heterologous cis-acting regulatory element for directing expression of said nucleic acid sequence encoding the type 1 BREX system, wherein said type 1 BREX system confers phage resistance to a bacterium recombinantly expressing same, wherein said bacterium does not endogenously express a functional type 1 BREX system, and wherein said bacterium is a species selected from the group consisting of a *Lactococcus* species, a *Streptococcus* species, a *Lactobacillus* species, a *Leuconostoc* species, an *Oenococcus* species, a *Pediococcus* species, a *Bifidobacterium* species, and a *Propionibacterium* species.

2. A phage defense composition, comprising as an active ingredient the expression vector of claim 1, and an acceptable carrier or diluent.

3. An isolated, genetically modified bacterium, wherein said bacterium does not express a functional type 1 Bacteriophage Exclusion (BREX) system endogenously, modified to express a functionally active type 1 BREX system that confers phage resistance to said bacterium, said type 1 BREX system comprising a pglX polypeptide comprising an adenine-specific methylase domain (pfam13659, COG1002/COG0286), a brxC/pglY polypeptide comprising an ATP binding domain (pfam10923), a pglZ polypeptide comprising an alkaline phosphatase domain (pfam08665), a brxL polypeptide comprising a Lon-like protease domain (COG4930), a brxA polypeptide comprising a DUF1819 domain (pfam08849), and a brxB polypeptide comprising a DUF1788 domain (pfam08747);

wherein the amino acid sequences of each of said type 1 BREX system polypeptides, are set forth as follows:
(a) the brxA polypeptide amino acid sequence is selected from the group consisting of SEQ ID NOs: 4953-5064, 5102-5367, 5399-5414, and 6225;
(b) the brxB polypeptide amino acid sequence selected from the group consisting of SEQ ID NO: 5570-5686, 5698-5939, 5944-5947, 6206, and 6227;
(c) the brxC/pglY polypeptide amino acid sequence selected from the group consisting of SEQ ID NO: 615, 617-735, 818-1110, 1170-1175, and 6229;
(d) a pglX polypeptide amino acid sequence selected from the group consisting of SEQ ID NO: 2766-2916, 2954-3251, 3276-3280, 6182, 6190, 6192, 6194, 6196, 6198, and 6231;
(e) a pglZ polypeptide amino acid sequence selected from the group consisting of SEQ ID NO: 1716-1834, 1905-2192, 2248, 2250, 6204, and 6233; and
(f) a brxL polypeptide amino acid sequence selected from the group consisting of SEQ ID NO: 4028-4298, 4300-4402, 6165, and 6235;

and wherein said bacterium is a species selected from the group consisting of a *Lactococcus* species, a *Streptococcus* species, a *Lactobacillus* species, a *Leuconostoc* species, an *Oenococcus* species, a *Pediococcus* species, a *Bifidobacterium* species, and a *Propionibacterium* species.

4. The isolated, genetically modified bacterium of claim 3, wherein said bacterium is resistant to: a first cycle phage infection, phage lysogeny, lytic phage and/or phage DNA replication.

5. A method of protecting a bacterium from phage attack, wherein said bacterium does not express a functional type 1 Bacteriophage Exclusion (BREX) system endogenously, the method comprising:
  (1) introducing into the bacterium an expression vector comprising a nucleic acid sequence encoding a functionally active type 1 Bacteriophage Exclusion (BREX) system comprising a pglX polypeptide comprising an adenine-specific methylase domain (pfam13659, COG1002/COG0286), a brxC/pglY polypeptide comprising an ATP binding domain (pfam10923), a pglZ polypeptide comprising an alkaline phosphatase domain (pfam08665), a brxL polypeptide comprising a Lon-like protease domain (COG4930), a brxA polypeptide comprising a DUF1819 domain (pfam08849), and a brxB polypeptide comprising a DUF1788 domain (pfam08747);
  wherein the amino acid sequences of each of said type 1 BREX system polypeptides, are set forth as follows:
    (a) the brxA polypeptide amino acid sequence is selected from the group consisting of SEQ ID NOs: 4953-5064, 5102-5367, 5399-5414, and 6225;
    (b) the brxB polypeptide amino acid sequence selected from the group consisting of SEQ ID NO: 5570-5686, 5698-5939, 5944-5947, 6206, and 6227;
    (c) the brxC/pglY polypeptide amino acid sequence selected from the group consisting of SEQ ID NO: 615, 617-735, 818-1110, 1170-1175, and 6229;
    (d) a pglX polypeptide amino acid sequence selected from the group consisting of SEQ ID NO: 2766-2916, 2954-3251, 3276-3280, 6182, 6190, 6192, 6194, 6196, 6198, and 6231;
    (e) a pglZ polypeptide amino acid sequence selected from the group consisting of SEQ ID NO: 1716-1834, 1905-2192, 2248 2250, and 6204, and 6233; and
    (f) a brxL polypeptide amino acid sequence selected from the group consisting of SEQ ID NO: 4028-4298, 4300-4402, 6165, and 6235; and
  (2) expressing in the bacterium said functional type 1 BREX system from said expression vector;
  wherein upon phage attack, said functional type 1 BREX system confers phage resistance to the bacterium and thereby protects the bacterium from phage attack;
  wherein said expression vector comprises a heterologous cis-acting regulatory element for directing expression of said nucleic acid sequence; and wherein said bacterium is a species selected from the group consisting of a *Lactococcus* species, a *Streptococcus* species, a *Lactobacillus* species, a *Leuconostoc* species, an *Oenococcus* species, a *Pediococcus* species, a *Bifidobacterium* species, and a *Propionibacterium* species.

6. The method of claim 5, wherein said phage is selected from the group consisting of SPβ, SP16, Zeta, Φ3T and SPO2.

7. The method of claim 5, wherein said type 1 BREX system does not confer resistance to phages Φ105, rho10 and rho14.

8. The method of claim 5, wherein said phage is a lytic phage.

9. An isolated bacterium comprising a nucleic acid sequence encoding a functionally active type 1 Bacteriophage Exclusion (BREX) system, said type 1 BREX system expressed from a plasmid or a transposon, wherein said isolated bacterium does not endogenously express said type 1 BREX system, wherein said functionally active type 1 BREX system confers phage resistance to the bacterium recombinantly expressing same, and wherein said type 1 BREX system comprises a pglX polypeptide comprising an adenine-specific methylase domain (pfam13659, COG1002/COG0286), a brxC/pglY polypeptide comprising an ATP binding domain (pfam10923), a pglZ polypeptide comprising an alkaline phosphatase domain (pfam08665), a brxL polypeptide comprising a Lon-like protease domain (COG4930), a brxA polypeptide comprising a DUF1819 domain (pfam08849), and a brxB polypeptide comprising a DUF1788 domain (pfam08747);
  wherein the amino acid sequences of each of said type 1 BREX system polypeptides, are set forth as follows:
    (a) the brxA polypeptide amino acid sequence is selected from the group consisting of SEQ ID NOs: 4953-5064, 5102-5367, 5399-5414, and 6225;
    (b) the brxB polypeptide amino acid sequence selected from the group consisting of SEQ ID NO: 5570-5686, 5698-5939, 5944-5947, 6206, and 6227;
    (c) the brxC/pglY polypeptide amino acid sequence selected from the group consisting of SEQ ID NO: 615, 617-735, 818-1110, 1170-1175, and 6229;
    (d) a pglX polypeptide amino acid sequence selected from the group consisting of SEQ ID NO: 2766-2916, 2954-3251, 3276-3280, 6182, 6190, 6192, 6194, 6196, 6198, and 6231;
    (e) a pglZ polypeptide amino acid sequence selected from the group consisting of SEQ ID NO: 1716-1834, 1905-2192, 2248 2250, and 6204, and 6233; and
    (f) a brxL polypeptide amino acid sequence selected from the group consisting of SEQ ID NO: 4028-4298, 4300-4402, 6165, and 6235;
  wherein said bacterium is a species selected from the group consisting of a *Lactococcus* species, a *Streptococcus* species, a *Lactobacillus* species, a *Leuconostoc* species, an *Oenococcus* species, a *Pediococcus* species, a *Bifidobacterium* species, and a *Propionibacterium* species.

* * * * *